US008945898B2

(12) United States Patent
Van Peij et al.

(10) Patent No.: US 8,945,898 B2
(45) Date of Patent: Feb. 3, 2015

(54) RECOMBINANT HOST CELL WITH DEFICIENCY IN NON-RIBOSOMAL PEPTIDE SYNTHASE PRODUCTION

(75) Inventors: Noel Nicolaas Maria Elisabeth Van Peij, Delfgauw (NL); Marcus Hans, Den Haag (NL); Martina Beishuizen, Rotterdam (NL); Dick Schipper, Delft (NL); Robertus Antonius Mijndert Van Der Hoeven, Katwijk (NL); Olaf Leonardus Schouten, Den Haag (NL)

(73) Assignee: DSM IP Assets B.V., Heerlen (NL)

( * ) Notice: Subject to any disclaimer, the term of this patent is extended or adjusted under 35 U.S.C. 154(b) by 0 days.

(21) Appl. No.: 13/806,128

(22) PCT Filed: Jul. 1, 2011

(86) PCT No.: PCT/EP2011/061163
§ 371 (c)(1),
(2), (4) Date: Feb. 25, 2013

(87) PCT Pub. No.: WO2012/001169
PCT Pub. Date: Jan. 5, 2012

(65) Prior Publication Data
US 2013/0144034 A1    Jun. 6, 2013

(30) Foreign Application Priority Data

Jul. 1, 2010   (EP) .................................... 10168174
Jan. 18, 2011  (EP) .................................... 11151308

(51) Int. Cl.
| C12N 9/96 | (2006.01) |
| C12P 21/02 | (2006.01) |
| C12N 9/18 | (2006.01) |
| C12N 9/00 | (2006.01) |
| C12N 15/80 | (2006.01) |

(52) U.S. Cl.
CPC . *C12P 21/02* (2013.01); *C12N 9/18* (2013.01);
       *C12N 9/93* (2013.01); *C12N 15/80* (2013.01)
USPC .......................................................... 435/188

(58) Field of Classification Search
CPC ........................... C12N 15/8247; C12N 9/0083
USPC ........................................................ 435/69.1
See application file for complete search history.

(56) References Cited

U.S. PATENT DOCUMENTS

2002/0155536 A1   10/2002  Van Den Brink et al.

FOREIGN PATENT DOCUMENTS

| WO | 98/46772 | 10/1998 | | |
| WO | 99/32617 | 7/1999 | | |
| WO | 00/39322 | 7/2000 | | |
| WO | WO0039322 | * 7/2000 | ............... | C12N 9/10 |
| WO | 2005/095624 | 10/2005 | | |

OTHER PUBLICATIONS

Stack et al., Nonribosomal peptide synthesis in *Aspergillus fumigatus* and other fungi. Microbiology. 153, 1297-1306, 2007.*
Dohren. A survey of nonribosomal peptide synthetase (NRPS) genes in *Aspergillus nidulans*. Fungal Genetics and Biology. 46: S45-S52, 2009.*
Cramer et al., Disruption of a Nonribosomal Peptide Synthetase in *Aspergillus fumigatus* Eliminates Gliotoxin Production. Eukaryotic Cell, 5,6: 972-980, Jun. 2006.*
GenBank accession No. DQ457015, mRNA, 2006.*
International Search Report Based on Application No. PCT/EP2011/061163 Mailed Oct. 17, 2011.
Cramer et al.; "Disruption of a Nonribosomal Peptide Synthetase in *Aspergillus fumigatus* Eliminates Gliotoxin Production"; Eukaryotic Cell; vol. 5; No. 6; Jun. 2006; pp. 972-980.
Roberts et al; "Heterologous Gene Expression in *Aspergillus niger*: A Glucoamylase-Porcine Pancreatic Prophospholipase A2 Fusion Protein Is Secreted and Processed to Yield Mature Enzyme"; Gene; Elsevier; Amsterdam, NL; vol. 122; No. 1; Dec. 1, 1992; pp. 155-161.
Jeenes et al.; "Heterologous Protein Production by Filamentous Fungi"; Biotechnology and Genetic Engineering Reviews; Intercept Ltd.; Andover, GB; vol. 9; Jan. 1, 1991; pp. 327-367.
Stack et al.; "Nonribosomal Peptide Synthesis in *Aspergillus fumigatus* and Other Fungi"; Microbiology; vol. 153; No. Part 5; May 2007; pp. 1297-1306.
Pel et al.; "Genome Sequencing and Analysis of the Versatile Cell Factory *Aspergillus niger* CBS 513.88"; Nature Biotechnology, Nature Publishing Group; New York, NY, US; vol. 25; No. 2; Feb. 1, 2007; pp. 221-231.

* cited by examiner

*Primary Examiner* — Tekchand Saidha
(74) *Attorney, Agent, or Firm* — Miles & Stockbridge, PC

(57) ABSTRACT

The present invention relates to a method for the production of a compound of interest by microbial fermentation, wherein the microbial host cell used has been modified in its genome such that it results in a deficiency in the production of at least one non-ribosomal peptide synthase. The present invention further relates to a microbial host cell that has been modified in its genome such that it results in a deficiency in the production of at least one non-ribosomal peptide synthase. The invention further relates to a compound of interest.

39 Claims, 6 Drawing Sheets

RECOMBINANT HOST CELL WITH DEFICIENCY IN NON-RIBOSOMAL PEPTIDE SYNTHASE PRODUCTION

CROSS REFERENCE TO RELATED APPLICATIONS

This application is a §371 National Stage Application of PCT/EP2011/061163 filed Jul. 1, 2011, which claims priority to European Application No. 10168174.0 filed Jul. 1, 2010 and European Application No. 11151308.1 filed Jan. 18, 2011.

BACKGROUND

1. Field of the Invention

The present invention relates to a method for the production of a compound of interest by microbial fermentation, wherein the microbial host cell used has been modified in its genome such that it results in a deficiency in the production of at least one non-ribosomal peptide synthase. The present invention further relates to a microbial host cell that has been modified in its genome such that it results in a deficiency in the production of at least one non-ribosomal peptide synthase. The invention further relates to a compound of interest.

2. Description of Related Art

An ever increasing number of compounds is produced by microbial fermentation at industrial scale. Such compounds of interest range from primary and secondary metabolites, such as e.g. citric acid and antibiotics, respectively, to proteins, enzymes and even complete microorganisms, e.g. in the form of baker's yeast or biomass.

At microbial fermentation on industrial scale several problems may occur that ultimately result in reduction of the yield of the compound of interest and/or increase the cost price of the compound of interest. The problems may e.g. relate to viscosity of the broth during fermentation, oxygen transfer during fermentation or formation of unwanted by-products such as oxalate. A problem encountered in microbial fermentations with the use of certain host systems such as fungi is the production of toxic products such as mycotoxins. WO00/39322 describes the provision of an *Aspergillus* mutant which is deficient in the production of toxins and its use in a process to produce a polypeptide of interest. Other problems inter alia encountered in microbial fermentations are hampered filtration of the product during down stream processing and coating of the fermentation devices due to unwanted insoluble by-products produced by the microbial cell during the fermentation.

To reduce problems during fermentation, the fermentation and downstream processing conditions for a specific product can be optimized. However, this optimization per product does not allow standardisation of fermentation and down stream processing protocols. When typically a large number of different products is produced within one facility, standardization of fermentation and down stream processing protocols results in a substantially more efficient use of the facility and thus more efficient production.

There is thus still a need for an improved method for the production of a compound of interest by microbial fermentation which allows standardised fermentation protocols and improved down stream processing.

SUMMARY

In accordance with the present invention there is provided a method for the production of a compound of interest by microbial fermentation comprising:

a. providing a microbial host cell,
b. culturing said microbial host cell under conditions conducive to the expression of the compound of interest,
c. isolating the compound of interest from the culture medium, wherein said microbial host cell has been modified in its genome such that it results in a deficiency in the production of at least one non-ribosomal peptide synthase.

BRIEF DESCRIPTION OF THE SEQUENCE LISTING

Figure 1:
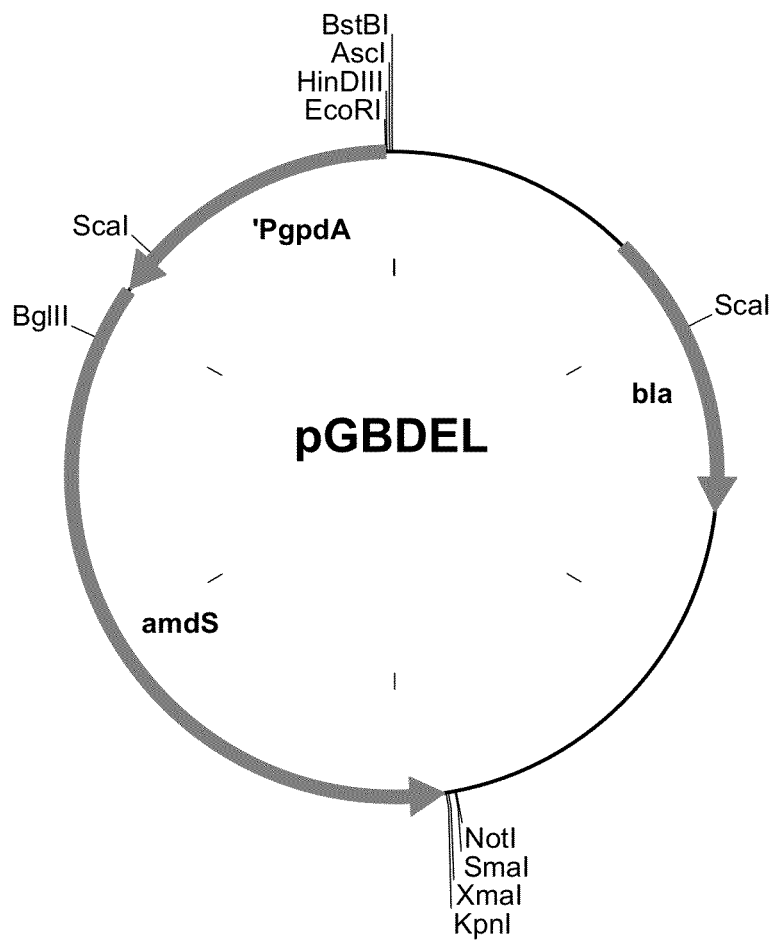
FIG. 1 depicts general cloning vector pGBDEL, which is used for construction of deletion vectors in the examples. pGBDEL comprises the amdS bi-directional selection marker.

SEQ ID NO: 1 depicts the genomic sequence of the npsA gene of *Aspergillus niger*, including 2 kb flanking regions. The genomic sequence comprises the cDNA according to SEQ ID NO: 2.
SEQ ID NO: 2 depicts the cDNA (coding sequence) of the *Aspergillus niger* npsA.
SEQ ID NO: 3 depicts the mRNA sequence of the *Aspergillus niger* npsA
SEQ ID NO: 4 depicts the protein sequence of the *Aspergillus niger* npsA
SEQ ID NO: 5 depicts the sequence of the peptide VVFF
SEQ ID NO: 6 depicts the sequence of the peptide VVFY
SEQ ID NO: 7 depicts the genomic sequence of the npsB gene of *Aspergillus niger*, including 2 kb flanking regions. The genomic sequence comprises the cDNA according to SEQ ID NO: 8.

SEQ ID NO: 8 depicts the cDNA (coding sequence) of the *Aspergillus niger* npsB.
SEQ ID NO: 9 depicts the mRNA sequence of the *Aspergillus niger* npsB
SEQ ID NO: 10 depicts the protein sequence of the *Aspergillus niger* npsB
SEQ ID NO: 11 depicts the genomic sequence of the npsC gene of *Aspergillus niger*, including 2 kb flanking regions. The genomic sequence comprises the cDNA according to SEQ ID NO: 12.
SEQ ID NO: 12 depicts the cDNA (coding sequence) of the *Aspergillus niger* npsC.
SEQ ID NO: 13 depicts the mRNA sequence of the *Aspergillus niger* npsC
SEQ ID NO: 14 depicts the protein sequence of the *Aspergillus niger* npsC
SEQ ID NO: 15 depicts the genomic sequence of the npsD gene of *Aspergillus niger*, including 2 kb flanking regions. The genomic sequence comprises the cDNA according to SEQ ID NO: 16.
SEQ ID NO: 16 depicts the cDNA (coding sequence) of the *Aspergillus niger* npsD.
SEQ ID NO: 17 depicts the mRNA sequence of the *Aspergillus niger* npsD
SEQ ID NO: 18 depicts the protein sequence of the *Aspergillus niger* npsD
SEQ ID NO: 19 depicts the genomic sequence of the npsE gene of *Aspergillus niger*, including 2 kb flanking regions. The genomic sequence comprises the cDNA according to SEQ ID NO: 20.
SEQ ID NO: 20 depicts the cDNA (coding sequence) of the *Aspergillus niger* npsE.
SEQ ID NO: 21 depicts the mRNA sequence of the *Aspergillus niger* npsE
SEQ ID NO: 22 depicts the protein sequence of the *Aspergillus niger* npsE
SEQ ID NO: 23 depicts the sequence of the peptide VVWY
SEQ ID NO: 24 depicts the sequence of the peptide VLYW
SEQ ID NO: 25 depicts the sequence of the peptide VLFY
SEQ ID NO: 26 depicts the sequence of the peptide LLFY
SEQ ID NO: 27 depicts the sequence of the peptide VVFW
SEQ ID NO: 28 depicts the sequence of the peptide VLFF
SEQ ID NO: 29 depicts the codon optimized sequence of the *Penicillium chrysogenum* glucose oxidase gene.
SEQ ID NO: 30 depicts the protein sequence of the *Penicillium chrysogenum* glucose oxidase enzyme.
SEQ ID NO: 31 depicts the genomic sequence of the Pc16g04690 gene of *Penicillium chrysogenum*, including 2 kb flanking regions. The genomic sequence comprises the cDNA according to SEQ ID NO: 32.
SEQ ID NO: 32 depicts the cDNA (coding sequence) of the *Penicillium chrysogenum* Pc16g04690.
SEQ ID NO: 33 depicts the mRNA sequence of the *Penicillium chrysogenum* Pc16g04690
SEQ ID NO: 34 depicts the protein sequence of the *Penicillium chrysogenum* Pc16g04690
SEQ ID NO: 35 depicts the updated genomic sequence of the npsE gene of *Aspergillus niger*, including 2 kb flanking regions. The genomic sequence comprises the cDNA according to SEQ ID NO: 20.
SEQ ID NO: 36 depicts the updated cDNA (coding sequence) of the *Aspergillus niger* npsE
SEQ ID NO: 37 depicts the updated mRNA sequence of the *Aspergillus niger* npsE
SEQ ID NO: 38 depicts the updated protein sequence of the *Aspergillus niger* npsE
SEQ ID NO: 39-48 depict PCR primers

DETAILED DESCRIPTION OF A PREFERRED EMBODIMENT

It has now surprisingly been found that significant advantages can be obtained in methods for the production of a compound of interest by microbial fermentation when the microbial host cell used has been modified in its genome such that this modification results in a deficiency in the production of at least one non-ribosomal peptide synthase.

Non-ribosomal peptide synthases are involved in the synthesis of peptides, wherein the synthesis involves the direct coupling of the amino acids to form a peptide without the use of an RNA template. Non-ribosomal peptide synthases (also called synthetases) are inter alia reviewed in Fischbach and Walsh, *Chem. Rev.* 2006, 3468-3496: Assembly-line enzymology for polyketide and nonribosomal peptide antibiotics: logic, machinery and mechanics, non-ribosomal peptide synthases in *Aspergillus fumigatus* are reviewed in Stack et al., *Microbiology* (2007) 153, 1297-1306. Cramer et al., *Eukaryotic Cell*, June 2006, 972-980 disclose the disruption of a gliP gene encoding for a non-ribosomal peptide synthase responsible for gliotoxin production in *A. fumigatus*.

In the context of the present invention the term "synthase" and "synthetase" can be used interchangeably and have the same meaning.

Accordingly, the present invention provides for a method for the production of a compound of interest by microbial fermentation comprising:
 a. providing a microbial host cell,
 b. culturing said microbial host cell under conditions conducive to the expression of the compound of interest,
 c. isolating the compound of interest from the culture medium,
 wherein said microbial host cell has been modified in its genome such that it results in a deficiency in the production of at least one non-ribosomal peptide synthase. Said method is herein referred to as the method according to the invention. Said microbial host cell which has been modified in its genome such that it results in a deficiency in the production of at least one non-ribosomal peptide synthase is herein referred as the microbial host cell according to the invention.

One example of the advantages of the method according to the invention is improved down stream processing of a compound of interest since e.g. less insoluble by-products may be produced by the microbial host cell during fermentation and therefore the filtration behaviour of the fermentation broth may be improved due to less clogging of filters. Another example is that coating of the equipment by said insoluble by-product may be reduced or may not occur. Furthermore the filtrated fermentation broth containing the compound of interest may be less turbid.

Further advantage of the method according to the invention may be a lowered viscosity of the fermentation broth comprising the microbial host cells according to the invention which may facilitate the stirring of the host cell culture in a fermentor. Also, for example, the use of the microbial host cells according to the invention may lead to an improved oxygen transfer in the fermentation. Furthermore the yield and/or the purity of a compound of interest produced using the method according to the invention may be improved.

Preferably, the deficiency in the production of the at least one non-ribosomal peptide synthase results in the reduction of the production of at least one peptide product, wherein said peptide product consists of at least two coupled amino acids, wherein said coupling is mediated by the at least one non-ribosomal peptide synthase; the amino acids of said peptide product may be modified, before and/or after coupling, in their chemical structure. Preferably, analysis of the peptide product is performed using LC/MS analysis.

More preferably, in the method according to the invention, the deficiency in the production of the at least one non-ribosomal peptide synthase results in the reduction of the production of a tetrapeptide as preferably measured using the LC/MS analysis for cyclic tetrapeptide measurement as described in the experimental section and shortly described later on in the specification. Optionally said tetrapeptide or cyclic tetrapeptide can be measured by other techniques such as e.g. by NMR and/or HPLC. Preferably, the tetrapeptide is selected from the group of cyclic VVFF (SEQ ID NO: 5), cyclic VVFY (SEQ ID NO: 6), cyclic VVWY (SEQ ID NO: 23), cyclic VLYW (SEQ ID NO: 24), cyclic VLFY (SEQ ID NO: 25), cyclic LLFY (SEQ ID NO: 26), cyclic VVFW (SEQ ID NO: 27) and cyclic VLFF (SEQ ID NO: 28). More preferred tetrapeptides are cyclic VVFF (SEQ ID NO: 5) or cyclic VVFY (SEQ ID NO: 6).

Fermentation as used herein means that the microbial cells are cultivated in a nutrient medium suitable for production of the compound of interest using methods known in the art. For example, the cells may be cultivated by shake flask cultivation, small-scale or large-scale fermentation (including continuous, batch, fed-batch, or solid state fermentations) in laboratory or industrial fermentors performed in a suitable medium and under conditions allowing the compound of interest to be produced and/or isolated. The cultivation takes place in a suitable nutrient medium comprising carbon and nitrogen sources and inorganic salts, using procedures known in the art (see, e.g., Bennett, J. W. and LaSure, L., eds., *More Gene Manipulations in Fungi*, Academic Press, CA, 1991). Suitable media are available from commercial suppliers or may be prepared using published compositions (e.g., in catalogues of the American Type Culture Collection). If the compound of interest is secreted into the nutrient medium, the compound can be isolated directly from the medium. If the compound of interest is not secreted, it can be isolated from cell lysates.

The compound of interest may be isolated by methods known in the art. For example, the compound of interest may be isolated from the nutrient medium by conventional procedures including, but not limited to, centrifugation, filtration, extraction, spray drying, evaporation, or precipitation. The isolated compound of interest may then be further purified by a variety of procedures known in the art including, but not limited to, chromatography (e.g., ion exchange, affinity, hydrophobic, chromatofocusing, and size exclusion), electrophoretic procedures (e.g., preparative isoelectric focusing), differential solubility (e.g., ammonium sulfate precipitation), or extraction (see, e.g., *Protein Purification*, J.-C. Janson and Lars Ryden, editors, VCH Publishers, New York, 1989). In some applications the compound of interest may be used without substantial isolation from the culture broth; separation of the culture medium from the biomass may be adequate.

Deficiency of a microbial host cell in the production of at least one non-ribosomal peptide synthase is herein defined as a phenotypic feature wherein the cell, due to modification in the genome: a) produces less of the non-ribosomal peptide synthase and/or b) has a reduced expression level of the mRNA transcribed from a gene encoding the non-ribosomal peptide synthase and/or c) produces a non-ribosomal peptide synthase having a decreased protein activity or decreased specific protein activity and/or d) produces less of a product produced by a non-ribosomal peptide synthase and combinations of one or more of these possibilities as compared to the parent microbial host cell that has not been modified in its genome according to the invention, when analysed under substantially identical conditions.

In this context a gene is herewith defined as a polynucleotide containing an open reading frame (ORF) together with its transcriptional control elements (promoter and terminator), the ORF being the region on the gene that will be transcribed and translated into the protein sequence.

Therefore deficiency of a microbial host cell may be measured by determining the amount and/or (specific) activity of a non-ribosomal peptide synthase produced by the microbial host cell modified in its genome and/or it may be measured by determining the amount of mRNA transcribed from a gene encoding the non-ribosomal peptide synthase and/or it may be measured by determining the amount of a product produced by a non-ribosomal peptide synthase in a microbial host cell modified in its genome as defined above and/or it may be measured by gene or genome sequencing if compared to the parent host cell which has not been modified in its genome. Deficiency in the production of a non-ribosomal peptide synthase can be measured using any assay available to the skilled person, such as transcriptional profiling, Northern blotting RT-PCR, Q-PCR and Western blotting.

Preferably, the production of a non-ribosomal peptide synthase is measured using LC/MS analysis of a peptide product as defined earlier herein. More preferably, deficiency in the production of a non-ribosomal peptide synthase is measured using the LC/MS analysis for cyclic tetrapeptide measurement as described in the experimental section and briefly discussed hereafter. This assay measures a product the non-ribosomal peptide synthase relates to.

Shortly, according to the LC/MS analysis for cyclic tetrapeptide further described in the Experimental session, the LC/MS analysis was performed on a LTQ-Orbitrap mass spectrometer operating in positive ionization mode, coupled to an Accela pump, wherein the cyclic tetrapetide-containing sample was dissolved in TFA, spiked with the internal standard Val-Val-D-Phe-Tyr. diluted in water:acetonitrile: formic acid 50:50:0.1, the cyclic peptides separated using an Inertsil ODS-3 3μ 2.1*150 mm column (injection volume 25 μl, the flow rate 200 μl/min, column temperature 40° C.), using Eluent A: 0.1% formic acid in (Milli Q) water, Eluent B: 0.1% formic acid in acetonitrile using a gradient of 50% of Eluent B for two minutes, increasing to 80% of Eluent B in 10 minutes, keeping 80% Eluent B for 2 minutes, obtaining information on the individual cyclic peptides by full scan analysis in the Orbitrap for accurate mass determination and MS/MS analysis in the LTQ. Cyclic VVFF (cVVFF—SEQ ID NO: 5) (m/z 493) is characterized in MS/MS mode by the product ions having a m/z value of 465, 394, 346, and 247. cVVFY (SEQ ID NO: 6) (m/z 509) is characterized in MS/MS mode by the product ions having a m/z value of 481, 410, 346, and 247. cVVWY (SEQ ID NO: 23) (m/z 548) is characterized in MS/MS mode by the product ions having a m/z value of 520, 449, 385, and 286. cVLYW (SEQ ID NO: 24) (m/z 562) is characterized in MS/MS mode by the product ions having a m/z value of 534, 449, 399, and 350. cVLFY (SEQ ID NO: 25) (m/z 523) is characterized in MS/MS mode by the product ions having a m/z value of 495, 424, 410, 360 and 311. cLLFY (SEQ ID NO: 26) (m/z 537) is characterized in MS/MS mode by the product ions having a m/z value of 509, 424, 374, and 311. cVVFW (SEQ ID NO: 27) (m/z 532) is characterized in MS/MS mode by the product ions having a m/z value of 504, 433, 385, and 334. cVLFF (SEQ ID NO: 28) (m/z 507) is characterized in MS/MS mode by the product ions having a m/z value of 479, 408, 394, 360 and 295.

Modification of a genome of a microbial host cell is herein defined as any event resulting in a change in a polynucleotide sequence in the genome of the cell. A modification is construed as one or more modifications. Modification can be introduced by classical strain improvement, random mutagenesis followed by selection. Modification may be accomplished by the introduction (insertion), substitution or removal (deletion) of one or more nucleotides in a nucleotide sequence. This modification may for example be in a coding sequence or a regulatory element required for the transcription or translation of the polynucleotide. For example, nucleotides may be inserted or removed so as to result in the introduction of a stop codon, the removal of a start codon or a change or a frame-shift of the open reading frame of a coding sequence. The modification of a coding sequence or a regulatory element thereof may be accomplished by site-directed or random mutagenesis, DNA shuffling methods, DNA reassembly methods, gene synthesis (see for example Young and Dong, (2004), *Nucleic Acids Research* 32,(7) electronic access at nar.oupjournals.org/cgi/reprint/32/7/e59 or Gupta et al. (1968), *Proc. Natl. Acad. Sci USA*, 60: 1338-1344; Scarpulla et al. (1982), Anal. Biochem. 121:356-365; Stemmer et al. (1995), Gene 164: 49-53), or PCR generated mutagenesis in accordance with methods known in the art. Examples of random mutagenesis procedures are well known in the art, such as for example chemical (NTG for example) mutagenesis or physical (UV for example) mutagenesis. Examples of directed mutagenesis procedures are the Quick-Change™ TM site-directed mutagenesis kit (Stratagene Cloning Systems, La Jolla, Calif.), the The Altered Sites® II in vitro Mutagenesis Systems' (Promega Corporation) or by overlap extension using PCR as described in Gene. 1989 April 15;77(1):51-9. (Ho SN, Hunt HD, Horton RM, Pullen JK, Pease LR "Site-directed mutagenesis by overlap extension using the polymerase chain reaction") or using PCR as described in *Molecular Biology: Current Innovations and Future Trends*. (Eds. A.M. Griffin and H.G.Griffin. ISBN 1-898486-01-8;1995 Horizon Scientific Press, PO Box 1, Wymondham, Norfolk, U.K.).

A modification in the genome can be determined by comparing the DNA sequence of the modified cell to the sequence of the non-modified cell. Sequencing of DNA and genome sequencing can be done using standard methods known to the person skilled in the art, for example using Sanger sequencing technology and/or next generation sequencing technologies such as Illumina GA2, Roche 454, etc. as reviewed in Elaine R. Mardis (2008), Next-Generation DNA Sequencing Methods, Annual Review of Genomics and Human Genetics, 9: 387-402. (doi:10.1146/annurev.genom.9.081307.164359)

Preferred methods of modification are based on techniques of gene replacement, gene deletion, or gene disruption.

For example, in case of replacement of a polynucleotide, nucleic acid construct or expression cassette, an appropriate DNA sequence may be introduced at the target locus to be replaced. The appropriate DNA sequence is preferably present on a cloning vector. Preferred integrative cloning vectors comprise a DNA fragment, which is homologous to the polynucleotide and/or has homology to the polynucleotides flanking the locus to be replaced for targeting the integration of the cloning vector to this pre-determined locus. In order to promote targeted integration, the cloning vector is preferably linearized prior to transformation of the cell. Preferably, linearization is performed such that at least one but preferably either end of the cloning vector is flanked by sequences homologous to the DNA sequence (or flanking sequences) to be replaced. This process is called homologous recombination and this technique may also be used in order to achieve (partial) gene deletion or gene disruption.

For example, for gene disruption, a polynucleotide corresponding to the endogenous polynucleotide may be replaced by a defective polynucleotide, that is a polynucleotide that fails to produce a (fully functional) protein. By homologous recombination, the defective polynucleotide replaces the endogenous polynucleotide. It may be desirable that the defective polynucleotide also encodes a marker, which may be used for selection of transformants in which the nucleic acid sequence has been modified.

Alternatively or in combination with other mentioned techniques, a technique based on in vivo recombination of cosmids in *E. coli* can be used, as described in: A rapid method for efficient gene replacement in the filamentous fungus *Aspergillus nidulans* (2000) Chaveroche, M-K., Ghico, J-M. and d'Enfert C; *Nucleic acids Research*, vol 28, no 22.

Alternatively, modification, wherein said host cell produces less of or is deficient in the production of a protein such as a non-ribosomal peptide synthase encoded by a polynucleotide may be performed by established anti-sense techniques using a nucleotide sequence complementary to the nucleic acid sequence of the polynucleotide. More specifically, expression of the polynucleotide by a host cell may be reduced or eliminated by introducing a nucleotide sequence complementary to the nucleic acid sequence of the polynucleotide, which may be transcribed in the cell and is capable of hybridizing to the mRNA produced in the cell. Under conditions allowing the complementary anti-sense nucleotide sequence to hybridize to the mRNA, the amount of protein translated is thus reduced or eliminated. An example of expressing an antisense-RNA is shown in Appl. Environ. Microbiol. 2000 February; 66(2):775-82. (Characterization of a foldase, protein disulfide isomerase A, in the protein secretory pathway of *Aspergillus niger*. Ngiam C, Jeenes D J, Punt P J, Van Den Hondel C A, Archer D B) or (Zrenner R, Willmitzer L, Sonnewald U. *Analysis of the expression of potato uridinediphosphate-glucose pyrophosphorylase and its inhibition by antisense RNA. Planta.* (1993); 190(2):247-52.).

Furthermore, modification, downregulation or inactivation of a polynucleotide may be obtained via the RNA interference (RNAi) technique (FEMS Microb. Lett. 237 (2004): 317-324). In this method identical sense and antisense parts of the nucleotide sequence, which expression is to be affected, are cloned behind each other with a nucleotide spacer in between, and inserted into an expression vector. After such a molecule is transcribed, formation of small nucleotide fragments will lead to a targeted degradation of the mRNA, which is to be affected. The elimination of the specific mRNA can be to various extents. The RNA interference techniques described in WO2008/053019, WO2005/05672A1, WO2005/026356A1, Oliveira et al., "*Efficient cloning system for construction of gene silencing vectors in Aspergillus niger*" (2008) Appl. Microbiol. and Biotechnol. 80 (5): 917-924 and/or Barnes et al., "siRNA as a molecular tool for use in *Aspergillus niger*" (2008) *Biotechnology Letters* 30 (5): 885-890 may be used for downregulation, modification or inactivation of a polynucleotide.

Preferred methods for modification are the methods described in the experimental section herein.

The microbial host cell used in the method according to the invention may be any host cell. For specific uses of a compound produced in a microbial host cell, the selection of the host cell may be made according to such use. Where e.g. the compound produced in a host cell according to the invention is to be used in food applications, a host cell may be selected from a food-grade organism such as *Saccharomyces cerevisiae*. Specific uses include, but are not limited to, food, (animal) feed, pharmaceutical, agricultural such as crop-protection, and/or personal care applications.

The microbial host cell used in the method according to the invention may be a prokaryotic cell. Preferably, the prokaryotic host cell is bacterial cell. The term "bacterial cell" includes both Gram-negative and Gram-positive microorganisms. Suitable bacteria may be selected from e.g. *Escherichia, Anabaena, Caulobactert, Gluconobacter, Rhodobacter, Pseudomonas, Paracoccus, Bacillus, Brevibacterium, Corynebacterium, Rhizobium (Sinorhizobium), Flavobacterium, Klebsiella, Enterobacter, Lactobacillus, Lactococcus, Methylobacterium, Staphylococcus* or *Streptomyces*. Preferably, the bacterial cell is selected from the group consisting of *B. subtilis, B. amyloliquefaciens, B. licheniformis, B. puntis, B. megaterium, B. halodurans, B. pumilus, G. oxydans, Caulobactert crescentus* CB 15, *Methylobacterium extorquens, Rhodobacter sphaeroides, Pseudomonas zeaxanthinifaciens, Paracoccus denitrificans, E. coli, C. glutamicum, Staphylococcus carnosus, Streptomyces lividans, Sinorhizobium melioti* and *Rhizobium radiobacter*.

According to an embodiment, the host cell according to the invention is a eukaryotic host cell. Preferably, the eukaryotic cell is a mammalian, insect, plant, fungal, or algal cell. Preferred mammalian cells include e.g. Chinese hamster ovary (CHO) cells, COS cells, 293 cells, PerC6 cells, and hybridomas. Preferred insect cells include e.g. Sf9 and Sf21 cells and derivatives thereof. More preferably, the eukaryotic cell is a fungal cell, i.e. a yeast cell, such as *Candida, Hansenula, Kluyveromyces, Pichia, Saccharomyces, Schizosaccharomyces*, or *Yarrowia* strain. More preferably from *Kluyveromyces lactis, S. cerevisiae, Hansenula polymorpha, Yarrowia lipolytica* and *Pichia pastoris*, or a filamentous fungal cell. Most preferably, the eukaryotic cell is a filamentous fungal cell.

Filamentous fungi include all filamentous forms of the subdivision *Eumycota* and *Oomycota* (as defined by Hawksworth et al., In, Ainsworth and Bisby's Dictionary of The Fungi, 8th edition, 1995, CAB International, University Press, Cambridge, UK). The filamentous fungi are characterized by a mycelial wall composed of chitin, cellulose, glucan, chitosan, mannan, and other complex polysaccharides. Vegetative growth is by hyphal elongation and carbon catabolism is obligately aerobic. Filamentous fungal strains include, but are not limited to, strains of *Acremonium, Agaricus, Aspergillus, Aureobasidium, Chrysosporium, Coprinus, Cryptococcus, Filibasidium, Fusarium, Humicola, Magnaporthe, Mucor, Myceliophthora, Neocaffimastix, Neurospora, Paecilomyces, Penicillium, Piromyces, Panerochaete, Pleurotus, Schizophyllum, Talaromyces, Thermoascus, Thielavia, Tolypocladium*, and *Trichoderma*.

Preferred filamentous fungal cells belong to a species of an *Acremonium, Aspergillus, Chrysosporium, Myceliophthora, Penicillium, Talaromyces, Thielavia, Fusarium* or *Trichoderma* genus, and most preferably a species of *Aspergillus niger, Acremonium alabamense, Aspergillus awamori, Aspergillus foetidus, Aspergillus sojae, Aspergillus fumigatus, Talaromyces emersonii, Aspergillus oryzae, Chrysosporium lucknowense, Fusarium oxysporum, Myceliophthora thermophila, Trichoderma reesei, Thielavia terrestris* or *Penicillium chrysogenum*. A more preferred host cell belongs to the genus *Aspergillus*, more preferably the host cell belongs to the species *Aspergillus niger*. When the host cell according to the invention is an *Aspergillus niger* host cell, the host cell preferably is CBS 513.88, CBS124.903 or a derivative thereof.

Several strains of filamentous fungi are readily accessible to the public in a number of culture collections, such as the American Type Culture Collection (ATCC), Deutsche Sammlung von Mikroorganismen and Zellkulturen GmbH (DSM), Centraalbureau Voor Schimmelcultures (CBS), Agricultural Research Service Patent Culture Collection, Northern Regional Research Center (NRRL), and All-Russian Collection of Microorganisms of Russian Academy of Sciences, (abbreviation in Russian—VKM, abbreviation in English—RCM), Moscow, Russia. Useful strains in the context of the present invention may be *Aspergillus niger* CBS 513.88, CBS124.903, *Aspergillus oryzae* ATCC 20423, IFO 4177, ATCC 1011, CBS205.89, ATCC 9576, ATCC14488-14491, ATCC 11601, ATCC12892, *P. chrysogenum* CBS 455.95, *P. chrysogenum* Wisconsin54-1255(ATCC28089), *Penicillium citrinum* ATCC 38065, *Penicillium chrysogenum* P2, *Thielavia terrestris* NRRL8126, *Talaromyces emersonii* CBS124.902, *Acremonium chrysogenum* ATCC 36225 or ATCC 48272, *Trichoderma reesei* ATCC 26921 or ATCC 56765 or ATCC 26921, *Aspergillus sojae* ATCC11906, *Myceliophthora thermophila* C1, Garg 27K, VKM-F 3500 D, *Chrysosporium lucknowense* C1, Garg 27K, VKM-F 3500 D, ATCC44006 and derivatives thereof.

Preferably the microbial host cell according to the invention which has been modified in its genome such that it results in a deficiency in the production of at least one non-ribosomal peptide synthase has not been modified to disrupt the gliP gene encoding for a non-ribosomal peptide synthase responsible for gliotoxin production. Preferably the microbial host cell according to the invention which has been modified in its genome such that it results in a deficiency in the production of at least one non-ribosomal peptide synthase is not an *Aspergillus fumigatus* host cell which has been modified to disrupt the gliP gene encoding for a non-ribosomal peptide synthase responsible for gliotoxin production.

Preferably, when the host cell used in the methods according to the invention is a filamentous fungal host cell, the host cell which has been modified in its genome such that it results in a deficiency in the production of at least one non-ribosomal peptide synthase, preferably a non-ribosomal peptide synthase according to the invention, more preferably a non-ribosomal peptide synthase npsE (with a genomic sequence as depicted in SEQ ID NO: 35, the coding sequence depicted in SEQ ID NO: 36, the mRNA depicted in SEQ ID NO: 37 and the nrps protein depicted in SEQ ID NO: 38) additionally comprises one or more modifications in its genome in a polynucleotide encoding a product selected from the group of glucoamylase (glaA), acid stable alpha-amylase (amyA), neutral alpha-amylase (amyBI and amyBII), oxalic acid hydrolase (oahA), a toxin, preferably ochratoxin and/or fumonisin, and protease transcriptional regulator prtT such that the host cell is deficient in at least one product encoded by the polynucleotide comprising the modification.

Therefore the fungal host cell additionally comprises modifications in its genome such that it is deficient in at least one of glucoamylase (glaA), acid stable alpha-amylase (amyA), neutral alpha-amylase (amyBI and amyBII), oxalic acid hydrolase (oahA), a toxin, such as ochratoxin and fumonisin, preferably ochratoxin and/or fumonisin, more preferably ochratoxin A and/or fumonisin B2, and protease transcriptional regulator prtT. Preferably, the host cell additionally comprises one or more modifications in its genome in a polynucleotide encoding the major extracellular aspartic protease PepA such that the host cell is deficient in the major aspartic protease PepA. For example the host cell according to the invention may further comprise a disruption of the pepA gene encoding the major extracellular aspartic protease PepA. Preferably the host cell according to the invention additionally comprises one or more modifications in its genome in a polynucleotide encoding the hdfA gene such that the host cell is deficient in hdfA. For example the host cell according to the invention may further comprise a disruption of the hdfA gene.

Preferably the host cell additionally comprises at least two substantially homologous DNA domains suitable for integration of one or more copies of a polynucleotide encoding a compound of interest wherein at least one of the at least two substantially homologous DNA domains is adapted to have enhanced integration preference for the polynucleotide encoding a compound of interest compared to the substantially homologous DNA domain it originates from, and wherein the substantially homologous DNA domain where the adapted substantially homologous DNA domain originates from has a gene conversion frequency that is at least 10% higher than one of the other of the at least two substantially homologous DNA domains. These cells have been described in WO2011/009700. Strains containing two or more copies of these substantially homologous DNA domains are also referred hereafter as strain containing two or more amplicons. Examples of host cells comprising such amplicons are e.g. described in van Dijck et al, 2003, Regulatory Toxicology and Pharmacology 28; 27-35: *On the safety of a new generation of DSM Aspergillus niger enzyme production strains*. In van Dijck et al, an *Aspergillus niger* strain is described that comprises 7 amplified glucoamylase gene loci, i.e. 7 amplicons. In this context preferred host cells which may contain two or more amplicons belong to a species of an *Acremonium, Aspergillus, Chrysosporium, Myceliophthora, Penicillium, Talaromyces, Thielavia, Fusarium* or *Trichoderma* genus, and more preferably a species of *Aspergillus niger, Acremonium alabamense, Aspergillus awamori, Aspergillus foetidus, Aspergillus sojae, Aspergillus fumigatus, Talaromyces emersonii, Aspergillus oryzae, Chrysosporium lucknowense, Fusarium oxysporum, Myceliophthora thermophila, Trichoderma reesei, Thielavia terrestris* or *Penicillium chrysogenum*. Preferred host cells within this context are filamentous fungus host cells, preferably *A. niger* host cells, comprising two or more amplicons, preferably two or more ΔglaA amplicons (preferably comprising 3, 4, 5, 6, 7 ΔglaA amplicons) wherein the amplicon which has the highest frequency of gene conversion, has been adapted to have enhanced integration preference for the polynucleotide encoding a compound of interest compared to the amplicon it originates from. Adaptation of the amplicon can be performed according to any one of the methods described in WO2011/009700 (which is here fully incorporated by reference). An example of these host cells, described in WO2011/009700, are host cells comprising three ΔglaA amplicons being a BamHI truncated amplicon, a SalI truncated amplicon and a BglII truncated amplicon and wherein the BamHI amplicon has been adapted to have enhanced integration preference for a polynucleotide encoding a compound of interest compared to the BamHI amplicon it originates from. Host cells comprising two or more amplicons wherein one amplicon has been adapted to have enhanced integration preference for a polynucleotide encoding a compound of interest compared to the amplicon it originates from are hereafter referred as host cells comprising an adapted amplicon.

Preferably, the host cell according to the invention additionally comprises a modification of Sec61. A preferred SEC61 modification is a modification which results in a one-way mutant of SEC61; i.e. a mutant wherein the de novo synthesized protein can enter the ER via SEC61, but the protein cannot leave the ER via SEC61. Such modifications are extensively described in WO2005/123763. Most preferably, the SEC 61 modification is the S376W mutation in which Serine 376 is replaced by Tryptophan.

A preferred filamentous fungal host cell used in the method according to the invention, deficient in a non-ribosomal peptide synthase, preferably deficient in a non-ribosomal peptide synthase according to the invention, more preferably in a non-ribosomal peptide synthase npsE (with a genomic sequence as depicted in SEQ ID NO: 35, the coding sequence depicted in SEQ ID NO: 36, the mRNA depicted in SEQ ID NO: 37 and the nrps protein depicted in SEQ ID NO: 38) additionally is deficient in pepA, glucoamylase (glaA), acid stable alpha-amylase (amyA), neutral alpha-amylase (amyBI and amyBII) and oxalic acid hydrolase (oahA). Another preferred host cell, deficient in a non-ribosomal peptide synthase, preferably a non-ribosomal peptide synthase as defined above additionally is deficient in pepA, glucoamylase (glaA), acid stable alpha-amylase (amyA), neutral alpha-amylase (amyBI and amyBII), oxalic acid hydrolase (oahA) and hdfA. Another preferred host cell, deficient in a non-ribosomal peptide synthase, preferably a non-ribosomal peptide synthase as defined above additionally is deficient in pepA, glucoamylase (glaA), acid stable alpha-amylase (amyA), neutral alpha-amylase (amyBI and amyBII), oxalic acid hydrolase (oahA), a toxin, such as ochratoxin and/or fumonisin and hdfA. Another preferred host cell, deficient in a non-ribosomal peptide synthase preferably a non-ribosomal peptide synthase as defined above, additionally is deficient in pepA, glucoamylase (glaA), acid stable alpha-amylase (amyA), neutral alpha-amylase (amyBI and amyBII), oxalic acid hydrolase (oahA), a toxin, such as ochratoxin and/or fumonisin and hdfA. Preferably, these host cells are also deficient in prtT. Therefore another preferred host cell, deficient in a non-ribosomal peptide synthase, preferably a non-ribosomal peptide synthase as defined above, additionally is deficient in pepA, glucoamylase (glaA), acid stable alpha-amylase (amyA), neutral alpha-amylase (amyBI and amyBII), oxalic acid hydrolase (oahA), a toxin, such as ochratoxin and/or fumonisin, prtT and hdfA.

Another preferred host cells, deficient in a non-ribosomal peptide synthase, preferably deficient in a non-ribosomal peptide synthase according to the invention, more preferably in a non-ribosomal peptide synthase npsE (with a genomic sequence as depicted in SEQ ID NO: 35, the coding sequence depicted in SEQ ID NO: 36, the mRNA depicted in SEQ ID NO: 37 and the nrps protein depicted in SEQ ID NO: 38) additionally is deficient in pepA, glucoamylase (glaA), acid stable alpha-amylase (amyA), neutral alpha-amylase (amyBI and amyBII), oxalic acid hydrolase (oahA), ochratoxin, fumonisin, prtT, hdfA and comprises a SEC 61 modification being a S376W mutation in which Serine 376 is replaced by Tryptophan.

Preferably these host cells are filamentous fungal cells, more preferably *A. niger* host cells comprising an adapted amplicon as defined above. Therefore the host cells used in the method according to the invention, deficient in a non-ribosomal peptide synthase, preferably deficient in a non-ribosomal peptide synthase according to the invention, more preferably in a non-ribosomal peptide synthase npsE (with a genomic sequence as depicted in SEQ ID NO: 35, the coding sequence depicted in SEQ ID NO: 36, the mRNA depicted in SEQ ID NO: 37 and the nrps protein depicted in SEQ ID NO: 38) are filamentous fungus host cells, preferably *A. niger* host cells additionally deficient in pepA, glucoamylase (glaA), acid stable alpha-amylase (amyA), neutral alpha-amylase (amyBI and amyBII) and oxalic acid hydrolase (oahA) and comprising an adapted amplicon as defined above. Another preferred filamentous fungus host cell such as an *A. niger* host cell, deficient in a non-ribosomal peptide synthase, preferably deficient in a non-ribosomal peptide synthase according to the invention, more preferably in a non-ribosomal peptide synthase npsE (with a genomic sequence as depicted in SEQ ID NO: 35, the coding sequence depicted in SEQ ID NO: 36, the mRNA depicted in SEQ ID NO: 37 and the nrps protein depicted in SEQ ID NO: 38) additionally is deficient in pepA, glucoamylase (glaA), acid stable alpha-amylase (amyA), neutral alpha-amylase (amyBI and amyBII), oxalic acid hydrolase (oahA) and hdfA and comprises an adapted amplicon as defined above. Another preferred filamentous fungus host cell such as an *A. niger* host cell, deficient in a non-ribosomal peptide synthase, preferably deficient in a non-ribosomal peptide synthase according to the invention, more preferably in a non-ribosomal peptide synthase npsE (with a genomic sequence as depicted in SEQ ID NO: 35, the coding sequence depicted in SEQ ID NO: 36, the mRNA depicted in SEQ ID NO: 37 and the nrps protein depicted in SEQ ID NO: 38) additionally is deficient in pepA, glucoamylase (glaA), acid stable alpha-amylase (amyA), neutral alpha-amylase (amyBI and amyBII), oxalic acid hydrolase (oahA), one or more toxins, preferably ochratoxin and/or fumonisin and hdfA and comprises an adapted amplicon as defined above. Another preferred filamentous fungus host cell such as an *A. niger* host cell, deficient in a non-ribosomal peptide synthase, preferably deficient in a non-ribosomal peptide synthase according to the invention, more preferably in a non-ribosomal peptide synthase npsE (with a genomic sequence as depicted in SEQ ID NO: 35, the coding sequence depicted in SEQ ID NO: 36, the mRNA depicted in SEQ ID NO: 37 and the nrps protein depicted in SEQ ID NO: 38) additionally is deficient in pepA, glucoamylase (glaA), acid stable alpha-amylase (amyA), neutral alpha-amylase (amyBI and amyBII), oxalic acid hydrolase (oahA), one or more toxins, preferably ochratoxin and/or fumonisin and hdfA and comprises an adapted amplicon as defined above. Another preferred filamentous fungus host cell such as an *A. niger* host cell, deficient in a non-ribosomal peptide synthase, preferably deficient in a non-ribosomal peptide synthase according to the invention, more preferably in a non-ribosomal peptide synthase npsE (with a genomic sequence as depicted in SEQ ID NO: 35, the coding sequence depicted in SEQ ID NO: 36, the mRNA depicted in SEQ ID NO: 37 and the nrps protein depicted in SEQ ID NO: 38) additionally is deficient in pepA, glucoamylase (glaA), acid stable alpha-amylase (amyA), neutral alpha-amylase (amyBI and amyBII), oxalic acid hydrolase (oahA), one or more toxins, preferably ochratoxin and/or fumonisin prtT and hdfA and comprises an adapted amplicon as defined above.

Another preferred filamentous fungus host cell such as an *A. niger* host cells, deficient in a non-ribosomal peptide synthase preferably deficient in a non-ribosomal peptide synthase according to the invention, more preferably in a non-ribosomal peptide synthase npsE (with a genomic sequence as depicted in SEQ ID NO: 35, the coding sequence depicted in SEQ ID NO: 36, the mRNA depicted in SEQ ID NO: 37 and the nrps protein depicted in SEQ ID NO: 38) additionally is deficient in pepA, glucoamylase (glaA), acid stable alpha-amylase (amyA), neutral alpha-amylase (amyBI and amyBII), oxalic acid hydrolase (oahA), one or more toxins, preferably ochratoxin and/or fumonisin, prtT, hdfA, comprises a SEC 61 modification being a S376W mutation in which Serine 376 is replaced by Tryptophan and comprises an adapted amplicon as defined above.

The compound of interest in the method according to the invention can be any biological compound. The biological compound may be biomass or any biopolymer or metabolite. The biological compound may be encoded by a single polynucleotide or a series of polynucleotides composing a biosynthetic or metabolic pathway or may be the direct result of the product of a single polynucleotide or products of a series of polynucleotides. The biological compound may be native to the host cell or heterologous.

The term "heterologous biological compound" is defined herein as a biological compound which is not native to the cell; or a native biological compound in which structural modifications have been made to alter the native biological compound.

The term "biopolymer" is defined herein as a chain (or polymer) of identical, similar, or dissimilar subunits (monomers). The biopolymer may be any biopolymer. The biopolymer may for example be, but is not limited to, a nucleic acid, polyamine, polyol, polypeptide (or polyamide), or polysaccharide.

The biopolymer may be a polypeptide. The polypeptide may be any polypeptide having a biological activity of interest. The term "polypeptide" is not meant herein to refer to a specific length of the encoded product and, therefore, encompasses peptides, oligopeptides, and proteins. Polypeptides further include naturally occurring allelic and engineered variations of the above-mentioned polypeptides and hybrid polypeptides. The polypeptide may be native or may be heterologous to the host cell. The polypeptide may be a collagen or gelatin, or a variant or hybrid thereof. The polypeptide may be an antibody or parts thereof, an antigen, a clotting factor, an enzyme, a hormone or a hormone variant, a receptor or parts thereof, a regulatory protein, a structural protein, a reporter, or a transport protein, protein involved in secretion process, protein involved in folding process, chaperone, peptide amino acid transporter, glycosylation factor, transcription factor, synthetic peptide or oligopeptide, intracellular protein. The intracellular protein may be an enzyme such as, a protease, ceramidases, epoxide hydrolase, aminopeptidase, acylases, aldolase, hydroxylase, aminopeptidase, lipase. The polypeptide may be an enzyme secreted extracellularly. Such enzymes may belong to the groups of oxidoreductase, transferase, hydrolase, lyase, isomerase, ligase, catalase, cellulase, chitinase, cutinase, deoxyribonuclease, dextranase, esterase. The enzyme may be a carbohydrase, e.g. cellulases such as endoglucanases, β-glucanases, cellobiohydrolases or β-glucosidases, hemicellulases or pectinolytic enzymes such as xylanases, xylosidases, mannanases, galactanases, galactosidases, pectin methyl esterases, pectin lyases, pectate lyases, endo polygalacturonases, exopolygalacturonases rhamnogalacturonases, arabanases, arabinofuranosidases, arabinoxylan hydrolases, galacturonases, lyases, or amylolytic enzymes; hydrolase, isomerase, or ligase, phosphatases such as phytases, esterases such as lipases, proteolytic enzymes, oxidoreductases such as oxidases, transferases, or isomerases. The enzyme may be a phytase. The enzyme may be an aminopeptidase, asparaginase, amylase, a maltogenic amylase, carbohydrase, carboxypeptidase, endo-protease, metallo-protease, serine-protease catalase, chitinase, cutinase, cyclodextrin glycosyltransferase, deoxyribonuclease, esterase, alpha-galactosidase, beta-galactosidase, glucoamylase, alpha-glucosidase, beta-glucosidase, haloperoxidase, protein deaminase, invertase, laccase, lipase, mannosidase, mutanase, oxidase, pectinolytic enzyme, peroxidase, phospholipase, galactolipase, polyphenoloxidase, ribonuclease, transglutaminase, or glucose oxidase, hexose oxidase, monooxygenase.

According to the present invention, a polypeptide or enzyme also can be a product as described in WO2010/102982. According to the present invention, a polypeptide can also be a fused or hybrid polypeptide to which another polypeptide is fused at the N-terminus or the C-terminus of the polypeptide or fragment thereof. A fused polypeptide is produced by fusing a nucleic acid sequence (or a portion thereof) encoding one polypeptide to a nucleic acid sequence (or a portion thereof) encoding another polypeptide.

Techniques for producing fusion polypeptides are known in the art, and include, ligating the coding sequences encoding the polypeptides so that they are in frame and expression of the fused polypeptide is under control of the same promoter (s) and terminator. The hybrid polypeptides may comprise a combination of partial or complete polypeptide sequences obtained from at least two different polypeptides wherein one or more may be heterologous to the host cell. Example of fusion polypeptides and signal sequence fusions are for example as described in WO2010/121933.

The biopolymer may be a polysaccharide. The polysaccharide may be any polysaccharide, including, but not limited to, a mucopolysaccharide (e.g., heparin and hyaluronic acid) and nitrogen-containing polysaccharide (eg., chitin). In a more preferred option, the polysaccharide is hyaluronic acid.

The polynucleotide of interest according to the invention may encode an enzyme involved in the synthesis of a primary or secondary metabolite, such as organic acids, carotenoids, (beta-lactam) antibiotics, and vitamins. Such metabolite may be considered as a biological compound according to the present invention.

The term "metabolite" encompasses both primary and secondary metabolites; the metabolite may be any metabolite. Preferred metabolites are citric acid, gluconic acid, fumaric acid, itaconic acid and succinic acid.

The metabolite may be encoded by one or more genes, such as in a biosynthetic or metabolic pathway. Primary metabolites are products of primary or general metabolism of a cell, which are concerned with energy metabolism, growth, and structure. Secondary metabolites are products of secondary metabolism (see, for example, R. B. Herbert, The Biosynthesis of Secondary Metabolites, Chapman and Hall, New York, 1981).

The primary metabolite may be, but is not limited to, an amino acid, fatty acid, nucleoside, nucleotide, sugar, triglyceride, or vitamin.

The secondary metabolite may be, but is not limited to, an alkaloid, coumarin, flavonoid, polyketide, quinine, steroid, peptide, or terpene. The secondary metabolite may be an antibiotic, antifeedant, attractant, bacteriocide, fungicide, hormone, insecticide, or rodenticide. Preferred antibiotics are cephalosporins and beta-lactams. Other preferred metabolites are exo-metabolites. Examples of exo-metabolites are Aurasperone B, Funalenone, Kotanin, Nigragillin, Orlandin, Other naphtho-γ-pyrones, Pyranonigrin A, Tensidol B, Fumonisin B2 and Ochratoxin A.

The biological compound may also be the product of a selectable marker. A selectable marker is a product of a polynucleotide of interest which product provides for biocide or viral resistance, resistance to heavy metals, prototrophy to auxotrophs, and the like. Selectable markers include, but are not limited to, amdS (acetamidase), argB (ornithinecarbamoyltransferase), bar (phosphinothricinacetyltransferase), hygB (hygromycin phosphotransferase), niaD (nitrate reductase), pyrG (orotidine-5'-phosphate decarboxylase), sC (sulfate adenyltransferase), trpC (anthranilate synthase), ble (phleomycin resistance protein), hyg (hygromycin), NAT or NTC (Nourseothricin) as well as equivalents thereof.

According to the invention, the compound of interest in the method according to the invention is preferably a polypeptide as described herein.

Preferably, the polypeptide in the method according to the invention is an enzyme as described herein.

According to the invention, the compound of interest in the method according to the invention is preferably a metabolite.

When the compound of interest is a biopolymer as defined earlier herein, the microbial cell may already be capable to produce the biopolymer. The microbial cell may also be provided with a homologous or heterologous expression construct that encodes a polypeptide involved in the production of the compound of interest. The person skilled in the art knows how to modify a microbial host cell such that it is capable of production of the polypeptide involved in the production of the compound of interest.

The term "nucleic acid construct" is herein referred to as a nucleic acid molecule, either single- or double-stranded, which is isolated from a naturally occurring gene or which has been modified to contain segments of nucleic acid which are combined and juxtaposed in a manner which would not otherwise exist in nature. The term nucleic acid construct is synonymous with the term "expression cassette" when the nucleic acid construct contains all the control sequences required for expression of a coding sequence, wherein said control sequences are operably linked to said coding sequence.

The term "operably linked" is defined herein as a configuration in which a control sequence is appropriately placed at a position relative to the coding sequence of the DNA sequence such that the control sequence directs the production of a polypeptide.

The term "control sequences" is defined herein to include all components, which are necessary or advantageous for the expression of mRNA and/or a polypeptide, either in vitro or in a host cell. Each control sequence may be native or foreign to the nucleic acid sequence encoding the polypeptide. Such control sequences include, but are not limited to, a leader, Shine-Delgarno sequence, optimal translation initiation sequences (as described in Kozak, 1991, J. Biol. Chem. 266: 19867-19870), a polyadenylation sequence, a pro-peptide sequence, a pre-pro-peptide sequence, a promoter, a signal sequence, and a transcription terminator. At a minimum, the control sequences include a promoter, and transcriptional and translational stop signals. Control sequences may be optimized to their specific purpose. Preferred optimized control sequences used in the present invention are those described in WO2006/077258, which is herein incorporated by reference.

The control sequences may be provided with linkers for the purpose of introducing specific restriction sites facilitating ligation of the control sequences with the coding region of the nucleic acid sequence encoding a polypeptide.

The control sequence may be an appropriate promoter sequence (promoter).

The control sequence may also be a suitable transcription terminator (terminator) sequence, a sequence recognized by a filamentous fungal cell to terminate transcription. The terminator sequence is operably linked to the 3'-terminus of the nucleic acid sequence encoding the polypeptide. Any terminator, which is functional in the cell, may be used in the present invention.

Preferred terminator sequences for filamentous fungal cells are obtained from the polynucleotides encoding *A. oryzae* TAKA amylase, *A. niger* glucoamylase (glaA), *A. nidulans* anthranilate synthase, *A. niger* alpha-glucosidase, trpC and *Fusarium oxysporum* trypsin-like protease.

The control sequence may also be a suitable leader sequence (leaders), a non-translated region of a mRNA which is important for translation by the filamentous fungal cell. The leader sequence is operably linked to the 5'-terminus of the nucleic acid sequence encoding the polypeptide. Any leader sequence, which is functional in the cell, may be used in the present invention.

Preferred leaders for filamentous fungal cells are obtained from the polynucleotides encoding *A. oryzae* TAKA amylase and *A. nidulans* triose phosphate isomerase and *A. niger* glaA and phytase.

Other control sequences may be isolated from the *Penicillium* IPNS gene, or pcbC gene, the beta tubulin gene. All the control sequences cited in WO 01/21779 are herewith incorporated by reference.

The control sequence may also be a polyadenylation sequence, a sequence which is operably linked to the 3'-terminus of the nucleic acid sequence and which, when transcribed, is recognized by the filamentous fungal cell as a signal to add polyadenosine residues to transcribed mRNA. Any polyadenylation sequence, which is functional in the cell, may be used in the present invention.

Preferred polyadenylation sequences for filamentous fungal cells are obtained from the polynucleotides encoding *A. oryzae* TAKA amylase, *A. niger* glucoamylase, *A. nidulans* anthranilate synthase, *Fusarium oxysporum* trypsin-like protease and *A. niger* alpha-glucosidase.

The term "promoter" is defined herein as a DNA sequence that binds RNA polymerase and directs the polymerase to the correct downstream transcriptional start site of a nucleic acid sequence encoding a biological compound to initiate transcription. RNA polymerase effectively catalyzes the assembly of messenger RNA complementary to the appropriate DNA strand of a coding region. The term "promoter" will also be understood to include the 5'-non-coding region (between promoter and translation start) for translation after transcription into mRNA, cis-acting transcription control elements such as enhancers, and other nucleotide sequences capable of interacting with transcription factors. The promoter may be any appropriate promoter sequence suitable for a eukaryotic or prokaryotic host cell, which shows transcriptional activity, including mutant, truncated, and hybrid promoters, and may be obtained from polynucleotides encoding extra-cellular or intracellular polypeptides either homologous (native) or heterologous (foreign) to the cell. The promoter may be a constitutive or inducible promoter.

Examples of inducible promoters that can be used are a starch-, cellulose-, hemicellulose (such as xylan- and/or xylose-inducible), copper-, oleic acid-inducible promoters. The promoter may be selected from the group, which includes but is not limited to promoters obtained from the polynucleotides encoding *A. oryzae* TAKA amylase, *Rhizomucor miehei* aspartic proteinase, *A. niger* neutral alpha-amylase, *A. niger* acid stable alpha-amylase, *A. niger* or *A. awamori* glucoamylase (glaA), *A. niger* or *A. awamori* endoxylanase (xlnA) or beta-xylosidase (xlnD), *T. reesei* cellobiohydrolase I (CBHI), *R. miehei* lipase, *A. oryzae* alkaline protease, *A. oryzae* triose phosphate isomerase, *A. nidulans* acetamidase, *Fusarium venenatum* amyloglucosidase (WO 00/56900), *Fusarium venenatum* Dania (WO 00/56900), *Fusarium venenatum* Quinn (WO 00/56900), *Fusarium oxysporum* trypsin-like protease (WO 96/00787), *Trichoderma reesei* beta-glucosidase, *Trichoderma reesei* cellobiohydrolase I, *Trichoderma reesei* cellobiohydrolase II, *Trichoderma reesei* endoglucanase I, *Trichoderma reesei* endoglucanase II, *Trichoderma reesei* endoglucanase III, *Trichoderma reesei* endoglucanase IV, *Trichoderma reesei* endoglucanase V, *Trichoderma reesei* xylanase I, *Trichoderma reesei* xylanase II, *Trichoderma reesei* beta-xylosidase, as well as the NA2-tpi promoter (a hybrid of the promoters from the polynucleotides encoding *A. niger* neutral alpha-amylase and *A. oryzae* triose phosphate isomerase), and mutant, truncated, and hybrid promoters thereof. Other examples of promoters are the promoters described in WO2006/092396 and WO2005/100573, which are herein incorporated by reference. An even other example of the use of promoters is described in WO2008/098933.

In order to facilitate expression, the polynucleotide encoding the polypeptide involved in the production of the compound of interest may be a synthetic polynucleotide. The synthetic polynucleotides may be optimized in codon use, preferably according to the methods described in WO2006/077258 and/or PCT/EP2007/055943 (published as WO2008/000632), which are herein incorporated by reference. PCT/EP2007/055943 addresses codon-pair optimization. Codon-pair optimization is a method wherein the nucleotide sequences encoding a polypeptide have been modified with respect to their codon-usage, in particular the codon-pairs that are used, to obtain improved expression of the nucleotide sequence encoding the polypeptide and/or improved production of the encoded polypeptide. Codon pairs are defined as a set of two subsequent triplets (codons) in a coding sequence.

In order to facilitate expression and/or translation, the gene encoding the polypeptide product may be comprised in an expression vector such that the gene encoding the polypeptide product of interest is operably linked to the appropriate control sequences for expression and/or translation in vitro, or in the filamentous fungal host cell.

The expression vector may be any vector (e.g., a plasmid or virus), which can be conveniently subjected to recombinant DNA procedures and can bring about the expression of the nucleic acid sequence encoding the polypeptide(s) of interest. The choice of the vector will typically depend on the compatibility of the vector with the cell into which the vector is to be introduced. The vectors may be linear or closed circular plasmids. The vector may be an autonomously replicating vector, i.e., a vector, which exists as an extra-chromosomal entity, the replication of which is independent of chromosomal replication, e.g., a plasmid, an extra-chromosomal element, a mini-chromosome, or an artificial chromosome. An autonomously maintained cloning vector may comprise the AMA1-sequence (see e.g. Aleksenko and Clutterbuck (1997), Fungal Genet. Biol. 21: 373-397).

Alternatively, the vector may be one which, when introduced into the host cell, is integrated into the genome and replicated together with the chromosome(s) into which it has been integrated. The integrative cloning vector may integrate at random or at a predetermined target locus in the chromosomes of the host cell. In a preferred embodiment of the invention, the integrative cloning vector comprises a DNA fragment, which is homologous to a DNA sequence in a predetermined target locus in the genome of host cell for targeting the integration of the cloning vector to this predetermined locus. In order to promote targeted integration, the cloning vector is preferably linearized prior to transformation of the cell. Linearization is preferably performed such that at least one but preferably either end of the cloning vector is flanked by sequences homologous to the target locus. The length of the homologous sequences flanking the target locus is preferably at least 30 bp, preferably at least 50 bp, preferably at least 0.1 kb, even preferably at least 0.2 kb, more preferably at least 0.5 kb, even more preferably at least 1 kb, most preferably at least 2 kb. Preferably, the efficiency of targeted integration into the genome of the host cell, i.e. integration in a predetermined target locus, is increased by augmented homologous recombination abilities of the host cell.

Preferably, the homologous flanking DNA sequences in the cloning vector, which are homologous to the target locus, are derived from a highly expressed locus meaning that they are derived from a gene, which is capable of high expression level in the host cell. A gene capable of high expression level, i.e. a highly expressed gene, is herein defined as a gene whose mRNA can make up at least 0.5% (w/w) of the total cellular mRNA, e.g. under induced conditions, or alternatively, a gene whose gene product can make up at least 1% (w/w) of the total cellular protein, or, in case of a secreted gene product, can be secreted to a level of at least 0.1 g/l (as described in EP 357 127 B1).

A number of preferred highly expressed fungal genes are given by way of example: the amylase, glucoamylase, alcohol dehydrogenase, xylanase, glyceraldehyde-phosphate dehydrogenase or cellobiohydrolase (cbh) genes from *Aspergilli, Chrysosporium* or *Trichoderma*. Most preferred highly expressed genes for these purposes are a glucoamylase gene, preferably an *A. niger* glucoamylase gene, an *A. oryzae* TAKA-amylase gene, an *A. nidulans* gpdA gene, a *Trichoderma reesei* cbh gene, preferably cbh1, a *Chrysosporium lucknowense* cbh gene or a cbh gene from *P. chrysogenum*.

More than one copy of a nucleic acid sequence may be inserted into the cell to increase production of the product (over-expression) encoded by said sequence. This can be done, preferably by integrating into its genome copies of the DNA sequence, more preferably by targeting the integration of the DNA sequence at one of the highly expressed locus defined in the former paragraph. Alternatively, this can be done by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent. To increase even more the number of copies of the DNA sequence to be over expressed the technique of gene conversion as described in WO98/46772 may be used.

The vector system may be a single vector or plasmid or two or more vectors or plasmids, which together contain the total DNA to be introduced into the genome of the host cell, or a transposon.

The vectors preferably contain one or more selectable markers, which permit easy selection of transformed cells. A selectable marker is a gene the product of which provides for biocide or viral resistance, resistance to heavy metals, prototrophy to auxotrophs, and the like. The selectable marker may be introduced into the cell on the expression vector as the expression cassette or may be introduced on a separate expression vector.

A selectable marker for use in a filamentous fungal cell may be selected from the group including, but not limited to, amdS (acetamidase), argB (ornithine carbamoyltransferase), bar (phosphinothricinacetyltransferase), bleA (phleomycin binding), hygB (hygromycinphosphotransferase), niaD (nitrate reductase), pyrG (orotidine-5'-phosphate decarboxylase), sC (sulfate adenyltransferase), NAT or NTC (Nourseothricin) and trpC (anthranilate synthase), as well as equivalents from other species. Preferred for use in an *Aspergillus* and *Penicillium* cell are the amdS (see for example EP 635574 B1, EP0758020A2, EP1799821A2, WO 97/06261A2) and pyrG genes of *A. nidulans* or *A. oryzae* and the bar gene of *Streptomyces hygroscopicus*. More preferably an amdS gene is used, even more preferably an amdS gene from *A. nidulans* or *A. niger*. A most preferred selectable marker gene is the *A. nidulans* amdS coding sequence fused to the *A. nidulans* gpdA promoter (see EP 635574 B1). Other preferred AmdS markers are those described in WO2006/040358. AmdS genes from other filamentous fungi may also be used (WO 97/06261).

The procedures used to ligate the elements described above to construct the recombinant expression vectors of the present invention are well known to one skilled in the art (see, e.g. Sambrook & Russell, *Molecular Cloning: A Laboratory Manual*, 3rd Ed., CSHL Press, Cold Spring Harbor, N.Y., 2001; and Ausubel et al., *Current Protocols in Molecular Biology*, Wiley InterScience, NY, 1995).

Furthermore, standard molecular cloning techniques such as DNA isolation, gel electrophoresis, enzymatic restriction modifications of nucleic acids, Southern analyses, transformation of cells, etc., are known to the skilled person and are for example described by Sambrook et al. (1989) "Molecular Cloning: a laboratory manual", Cold Spring Harbor Laboratories, Cold Spring Harbor, N.Y. and Innis et al. (1990) "PCR protocols, a guide to methods and applications" Academic Press, San Diego.

A nucleic acid may be amplified using cDNA, mRNA or alternatively, genomic DNA, as a template and appropriate oligonucleotide primers according to standard PCR amplification techniques. The nucleic acid so amplified can be cloned into an appropriate vector and characterized by DNA sequence analysis.

Preferably, the host cell is modified to improve the expression of the genes to enhance production of the polypeptides of interest.

Preferably, the efficiency of targeted integration into the genome of the host cell, i.e. integration in a predetermined target locus, is increased by augmented homologous recombination abilities of the host cell. Such phenotype of the cell preferably involves a deficient hdfA or hdfB as described in WO2005/095624. WO2005/095624 discloses a preferred method to obtain a filamentous fungal cell comprising increased efficiency of targeted integration.

Optionally, the host cell has been modified to comprise an elevated unfolded protein response (UPR) to enhance production abilities of a polypeptide of interest. UPR may be increased by techniques described in US2004/0186070A1 and/or US2001/0034045A1 and/or WO01/72783A2 and/or WO2005/123763. More specifically, the protein level of HAC1 and/or IRE1 and/or PTC2 may be modulated, and/or the SEC61 protein may be engineered in order to obtain a host cell having an elevated UPR.

The person skilled in the art knows how to transform cells with the one or more expression cassettes and the selectable marker. For example, the skilled person may use one or more expression vectors, wherein the one or more cloning vectors comprise the expression cassettes and the selectable marker.

Transformation of the cells may be conducted by any suitable known methods, including e.g. electroporation methods, particle bombardment or microprojectile bombardment, protoplast methods and *Agrobacterium* mediated transformation (AMT). Preferably the protoplast method is used. Procedures for transformation are described by J. R. S. Fincham, Transformation in fungi. 1989, Microbiological reviews. 53, 148-170.

Transformation of the host cell by introduction of a polynucleotide an expression vector or a nucleic acid construct into the cell is preferably performed by techniques well known in the art (see Sambrook & Russell; Ausubel, supra). Transformation may involve a process consisting of protoplast formation, transformation of the protoplasts, and regeneration of the cell wall in a manner known per se. Suitable procedures for transformation of *Aspergillus* cells are described in EP 238 023 and Yelton et al., 1984, Proceedings of the National Academy of Sciences USA 81:1470-1474. Suitable procedures for transformation of *Aspergillus* and other filamentous fungal host cells using *Agrobacterium tumefaciens* are described in e.g. De Groot et al., *Agrobacterium tumefaciens*-mediated transformation of filamentous fungi. Nat. Biotechnol. 1998, 16:839-842. Erratum in: Nat Biotechnol 1998 16:1074. A suitable method of transforming *Fusarium* species is described by Malardier et al., 1989, Gene 78:147156 or in WO 96/00787. Other methods can be applied such as a method using biolistic transformation as described in: Christiansen et al., Biolistic transformation of the obligate plant pathogenic fungus, *Erysiphe graminis* f.sp. hordei. 1995, Curr Genet. 29:100-102. Yeast may be transformed using the procedures described by Becker and Guarente, In Abelson, J. N. and Simon, M. I., editors, Guide to Yeast Genetics and Molecular Biology, Methods in Enzymology, Volume 194, pp 182-187, Academic Press, Inc., New York; Ito et al., 1983, Journal of Bacteriology 153: 163; and Hinnen et al., 1978, Proceedings of the National Academy of Sciences USA 75: 1920.

In order to enhance the amount of copies of the polynucleotide of interest (the gene) in the host cell, multiple transformations of the host cell may be required. In this way, the ratios of the different enzymes produced by the host cell may be influenced. Also, an expression vector may comprise multiple expression cassettes to increase the amount of copies of the polynucleotide(s) to be transformed.

Another way could be to choose different control sequences for the different polynucleotides, which—depending on the choice—may cause a higher or a lower production of the desired polypeptide(s).

The cells transformed with the selectable marker can be selected based on the presence of the selectable marker. In case of transformation of (Aspergillus) cells, usually when the cell is transformed with all nucleic acid material at the same time, when the selectable marker is present also the polynucleotide(s) encoding the desired polypeptide(s) are present.

Preferably, in the method according to the invention, the deficiency in the production of the at least one non-ribosomal peptide synthase by the microbial host cell is a reduction in production of at least 20% more preferably by at least 30%, more preferably by at least 40%, even more preferably at least 50%, even more preferably at least 60%, in particular at least 70%, more in particular at least 80%, for example at least 85%, for example at least 90%, for example at least 95%, for example at least 100% as preferably measured using the LC/MS analysis for cyclic tetrapeptide measurement as described in the experimental section and briefly outlined earlier in the specification.

Preferably, the deficiency in the production of at the least one non-ribosomal peptide synthase results in the reduction of the production of at least one peptide product, wherein said peptide product consists of at least two coupled amino acids, wherein said coupling is mediated by the at least one non-ribosomal peptide synthase; the amino acids of said peptide product may be modified, before and/or after coupling, in their chemical structure. Preferably, the reduction in production of the peptide product is at least 20% more preferably by at least 30%, more preferably by at least 40%, even more preferably at least 50%, even more preferably at least 60%, in particular at least 70%, more in particular at least 80%, for example at least 85%, for example at least 90%, for example at least 95%, for example at least 100% as preferably measured using LC/MS analysis of said peptide product.

More preferably, the deficiency in the production of at the least one non-ribosomal peptide synthase results in the reduction of the production of a tetrapeptide. Preferably, the reduction in production of the tetrapeptide is at least 20%, more preferably by at least 30%, more preferably by at least 40%, even more preferably at least 50%, even more preferably at least 60%, in particular at least 70%, more in particular at least 80%, for example at least 85%, for example at least 90%, for example at least 95%, for example at least 100% as preferably measured using the LC/MS analysis for cyclic tetrapeptide measurement as described in the experimental section and briefly outlined earlier in the specification.

Preferably, the tetrapeptide is selected from the group of cyclic VVFF (SEQ ID NO: 5), cyclic VVFY (SEQ ID NO: 6), cyclic VVWY (SEQ ID NO: 23), cyclic VLYW (SEQ ID NO: 24), cyclic VLFY (SEQ ID NO: 25), cyclic LLFY (SEQ ID NO: 26), cyclic VVFW (SEQ ID NO: 27) and cyclic VLFF (SEQ ID NO: 28). More preferred tetrapeptides are cyclic VVFF (SEQ ID NO: 5) or cyclic VVFY (SEQ ID NO: 6).

Preferably, the microbial host cell used in the method according to the invention is a filamentous fungus. More preferably, the microbial host cell is an *Aspergillus* or *Penicillium*. Even more preferably, the microbial host cell is an *Aspergillus niger* or *Penicillium chrysogenum*. Most preferably, the microbial host cell is an *Aspergillus niger*

For the purpose of this invention, it is defined here that in order to determine the percent identity of two amino acid sequences or of two nucleic acid sequences, the complete sequences are aligned for optimal comparison purposes. In order to optimize the alignment between the two sequences gaps may be introduced in any of the two sequences that are compared. Such alignment is carried out over the full length of the sequences being compared. The identity is the percentage of identical matches between the two sequences over the reported aligned region.

A comparison of sequences and determination of percent identity between two sequences can be accomplished using a mathematical algorithm. The skilled person will be aware of the fact that several different computer programs are available to align two sequences and determine the homology between two sequences (Kruskal, J. B. (1983) An overview of sequence comparison In D. Sankoff and J. B. Kruskal, (ed.), Time warps, string edits and macromolecules: the theory and practice of sequence comparison, pp. 1-44 Addison Wesley). The percent identity between two amino acid sequences can be determined using the Needleman and Wunsch algorithm for the alignment of two sequences. (Needleman, S. B. and Wunsch, C. D. (1970) J. Mol. Bioi. 48, 443-453). The algorithm aligns amino acid sequences as well as nucleotide sequences. The Needleman-Wunsch algorithm has been implemented in the computer program NEEDLE. For the purpose of this invention the NEEDLE program from the EMBOSS package was used (version 2.8.0 or higher, EMBOSS: *The European Molecular Biology Open Software Suite* (2000) Rice,P. Longden,I. and Bleasby,A. Trends in Genetics 16, 15 (6) pp276-277, emboss.bioinformatics.nl/). For protein sequences, EBLOSUM62 is used for the substitution matrix. For nucleotide sequences, EDNAFULL is used. Other matrices can be specified. For purpose of the invention, the parameters used for alignment of amino acid sequences are a gap-open penalty of 10 and a gap extension penalty of 0.5. The skilled person will appreciate that all these different parameters will yield slightly different results but that the overall percentage identity of two sequences is not significantly altered when using different algorithms.

The protein sequences mentioned herein can further be used as a "query sequence" to perform a search against sequence databases, for example to identify other family members or related sequences. Such searches can be performed using the BLAST programs. Software for performing BLAST analyses is publicly available through the National Center for Biotechnology Information (www.ncbi.nlm.nih.gov). BLASTP is used for amino acid sequences and BLASTN for nucleotide sequences. In the BLAST program, the default settings may be used:

Cost to open gap: default=5 for nucleotides/11 for proteins
Cost to extend gap: default=2 for nucleotides/1 for proteins
Penalty for nucleotide mismatch: default=−3
Reward for nucleotide match: default=1
Expect value: default=10
Wordsize: default=11 for nucleotides/28 for megablast/3 for proteins The nucleic acid sequences as mentioned herein can further be used as a "query sequence" to perform a search against public databases to, for example, identify other family members or related sequences. Such searches can be performed using the NBLAST and XBLAST programs (version 2.0) of Altschul, et al. (1990) J. Mol. Biol. 215:403-10. BLAST nucleotide searches can be performed with the NBLAST program, score=100, word-length=12 to obtain nucleotide sequences homologous to the nucleic acid molecules of the invention.

The sequence information as provided herein should not be so narrowly construed as to require inclusion of erroneously identified bases. The specific sequences disclosed herein can be readily used to isolate the complete gene from filamentous fungi, in particular *A. niger* which in turn can easily be subjected to further sequence analyses thereby identifying sequencing errors.

Unless otherwise indicated, all nucleotide sequences determined by sequencing a DNA molecule herein were determined using an automated DNA sequencer and all amino acid sequences of polypeptides encoded by DNA molecules determined herein were predicted by translation of a nucleic acid sequence determined as above. Therefore, as is known in the art for any DNA sequence determined by this automated approach, any nucleotide sequence determined herein may contain some errors. Nucleotide sequences determined by automation are typically at least about 90% identical, more typically at least about 95% to at least about 99.9% identical to the actual nucleotide sequence of the sequenced DNA molecule. The actual sequence can be more precisely determined by other approaches including manual DNA sequencing methods well known in the art. As is also known in the art, a single insertion or deletion in a determined nucleotide sequence compared to the actual sequence will cause a frame shift in translation of the nucleotide sequence such that the predicted amino acid sequence encoded by a determined nucleotide sequence will be completely different from the amino acid sequence actually encoded by the sequenced DNA molecule, beginning at the point of such an insertion or deletion.

The person skilled in the art is capable of identifying such erroneously identified bases and knows how to correct for such errors.

Preferably, the modification in the genome of the microbial host cell used in the method according to the invention is a modification in the genome on at least one position of at least one nucleic acid sequence encoding a non-ribosomal peptide synthase having at least 35% identity, more preferably at least 40% identity, more preferably at least 45% identity, more preferably at least 50% identity, even more preferably at least 55% identity, even more preferably at least 60% identity, even more preferably at least 65% identity, even more preferably at least 70% identity, even more preferably at least 75% identity, even more preferably at least 80% identity, even more preferably at least 85% identity, even more preferably at least 90% identity, for example at least 91% identity, for example at least 92% identity, for example at least 93% identity, for example at least 94% identity, for example at least 95% identity, for example at least 96% identity, for example at least 97% identity, for example at least 98% identity, for example at least 99% identity, for example 100% identity with a polypeptide selected from the group consisting of the polypeptide according to SEQ ID NO: 4, the polypeptide according to SEQ ID NO: 10, the polypeptide according to SEQ ID NO: 14, the polypeptide according to SEQ ID NO: 18, the polypeptide according to SEQ ID NO: 22, the polypeptide according to SEQ ID NO: 34 and the polypeptide according to SEQ ID NO: 38 and/or the modification in the genome of the microbial host cell in the method according to the invention is a modification resulting in the reduction of the amount of at least one mRNA having at least 60% identity, even more preferably at least 65% identity, even more preferably at least 70% identity, even more preferably at least 75% identity, even more preferably at least 80% identity, even more preferably at least 85% identity, even more preferably at least 90% identity, for example at least 91% identity, for example at least 92% identity, for example at least 93% identity, for example at least 94% identity, for example at least 95% identity, for example at least 96% identity, for example at least 97% identity, for example at least 98% identity, for example at least 99% identity, for example 100% identity with an mRNA selected from the group of the mRNA according to SEQ ID NO: 3, the mRNA according to SEQ ID NO: 9, the mRNA according to SEQ ID NO: 13, the mRNA according to SEQ ID NO: 17, the mRNA according to SEQ ID NO: 21, the mRNA according to SEQ ID NO: 33 and the mRNA according to SEQ ID NO: 37. Preferably, the polypeptide is one of the polypeptide according to SEQ ID NO: 34 and the polypeptide according to SEQ ID NO: 38 and the mRNA is one of the mRNA according to SEQ ID NO: 33 and the mRNA according to SEQ ID NO: 37.

Therefore in a preferred embodiment, the modification in the genome of the microbial host cell used in the method according to the invention is a modification in the genome on at least one position of the nucleic acid sequence encoding a non-ribosomal peptide synthase having at least 35% identity, more preferably at least 40% identity, more preferably at least 45% identity, more preferably at least 50% identity, even more preferably at least 55% identity, even more preferably at least 60% identity, even more preferably at least 65% identity, even more preferably at least 70% identity, even more preferably at least 75% identity, even more preferably at least 80% identity, even more preferably at least 85% identity, even more preferably at least 90% identity, for example at least 91% identity, for example at least 92% identity, for example at least 93% identity, for example at least 94% identity, for example at least 95% identity, for example at least 96% identity, for example at least 97% identity, for example at least 98% identity, for example at least 99% identity, for example 100% identity with a polypeptide according to SEQ ID NO: 38 and/or the modification in the genome of the microbial host cell in the method according to the invention is a modification resulting in the reduction of the amount of mRNA having at least 60% identity, even more preferably at least 65% identity, even more preferably at least 70% identity, even more preferably at least 75% identity, even more preferably at least 80% identity, even more preferably at least 85% identity, even more preferably at least 90% identity, for example at least 91% identity, for example at least 92% identity, for example at least 93% identity, for example at least 94% identity, for example at least 95% identity, for example at least 96% identity, for example at least 97% identity, for example at least 98% identity, for example at least 99% identity, for example 100% identity with the mRNA according to SEQ ID NO: 37.

In another preferred embodiment, the modification in the genome of the microbial host cell used in the method according to the invention is a modification in the genome on at least one position of the nucleic acid sequence encoding a non-ribosomal peptide synthase having at least 35% identity, more preferably at least 40% identity, more preferably at least 45% identity, more preferably at least 50% identity, even more preferably at least 55% identity, even more preferably at least 60% identity, even more preferably at least 65% identity, even more preferably at least 70% identity, even more preferably at least 75% identity, even more preferably at least 80% identity, even more preferably at least 85% identity, even more preferably at least 90% identity, for example at least 91% identity, for example at least 92% identity, for example at least 93% identity, for example at least 94% identity, for example at least 95% identity, for example at least 96% identity, for example at least 97% identity, for example at least 98% identity, for example at least 99% identity, for example 100% identity with a polypeptide according to SEQ ID NO: 34 and/or the modification in the genome of the microbial host cell in the method according to the invention is a modification resulting in the reduction of the amount of mRNA having at least 60% identity, even more preferably at least 65% identity, even more preferably at least 70% identity, even more preferably at least 75% identity, even more preferably at least 80% identity, even more preferably at least 85% identity, even more preferably at least 90% identity, for example at least 91% identity, for example at least 92% identity, for example at least 93% identity, for example at least 94% identity, for example at least 95% identity, for example at least 96% identity, for example at least 97% identity, for example at least 98% identity, for example at least 99% identity, for example 100% identity with the mRNA according to SEQ ID NO: 33.

In an alternative embodiment the polypeptide is that according to SEQ ID NO: 22 and the mRNA is that according to SEQ ID NO: 21.

In another alternative embodiment the polypeptide is that according to SEQ ID NO: 18 and the mRNA is that according to SEQ ID NO: 17.

In another alternative embodiment the polypeptide is that according to SEQ ID NO: 14 and the mRNA is that according to SEQ ID NO: 13.

In another alternative embodiment the polypeptide is that according to SEQ ID NO: 10 and the mRNA is that according to SEQ ID NO: 9.

In another alternative embodiment the polypeptide is that according to SEQ ID NO: 4 and the mRNA is that according to SEQ ID NO: 3.

Preferably, said modification results in reduction in production of the at least one non-ribosomal peptide synthase of at least 20% more preferably by at least 30%, more preferably by at least 40%, even more preferably at least 50%, even more preferably at least 60%, in particular at least 70%, more in particular at least 80%, for example at least 85%, for example at least 90%, for example at least 95%, for example at least 100% as preferably measured using the LC/MS analysis for cyclic tetrapeptide measurement as described in the experimental section and briefly outlined earlier in the specification. Preferably, the non-ribosomal polypeptide synthase is one of the polypeptide according to SEQ ID NO: 34 and the polypeptide according to SEQ ID NO: 38.

Preferably, the deficiency in the production of at the least one non-ribosomal peptide synthase results in the reduction of the production of at least one peptide product, wherein said peptide product consists of at least two coupled amino acids, wherein said coupling is mediated by the at least one non-ribosomal peptide synthase; the amino acids of said peptide product may be modified, before and/or after coupling, in their chemical structure. Preferably, the reduction in production of the peptide product is at least 20% more preferably by at least 30%, more preferably by at least 40%, even more preferably at least 50%, even more preferably at least 60%, in particular at least 70%, more in particular at least 80%, for example at least 85%, for example at least 90%, for example at least 95%, for example at least 100% as preferably measured using LC/MS analysis.

More preferably, the deficiency in the production of the at least one non-ribosomal peptide synthase results in the reduction of the production of a tetrapeptide. Preferably, the reduction in production of the tetrapeptide is at least 20% more preferably by at least 30%, more preferably by at least 40%, even more preferably at least 50%, even more preferably at least 60%, in particular at least 70%, more in particular at least 80%, for example at least 85%, for example at least 90%, for example at least 95%, for example at least 100% as preferably measured using the LC/MS analysis for cyclic tetrapeptide measurement as described in the experimental section and briefly outlined earlier in the specification.

Preferably, the tetrapeptide is selected from the group of cyclic VVFF (SEQ ID NO: 5), cyclic VVFY (SEQ ID NO: 6), cyclic VVWY (SEQ ID NO: 23), cyclic VLYW (SEQ ID NO: 24), cyclic VLFY (SEQ ID NO: 25), cyclic LLFY (SEQ ID NO: 26), cyclic VVFW (SEQ ID NO: 27) and cyclic VLFF (SEQ ID NO: 28). More preferred tetrapeptides are cyclic VVFF (SEQ ID NO: 5) or cyclic VVFY (SEQ ID NO: 6).

More preferably, the microbial host cell is an *Aspergillus* or *Penicillium*. Even more preferably, the microbial host cell is an *Aspergillus niger* or *Penicillium chrysogenum*. Most preferably, the microbial host cell is an *Aspergillus niger*

In some applications the compound of interest produced may be used without substantial isolation from the culture broth; separation of the culture medium from the biomass may be adequate. The present invention provides for such compound.

The compound of interest produced will accordingly comprise less of at least one peptide product, wherein said peptide product consists of at least two coupled amino acids, wherein said coupling is mediated by the at least one non-ribosomal peptide synthase, wherein the amino acids of said peptide product may be modified before and/or after coupling in their chemical structure, as compared to said compound of interest being produced under identical conditions in a parent microbial host cell that has not been modified in its genome according to the invention. Preferably, the compound of interest comprises at least 20% less, more preferably at least 30% less, more preferably at least 40% less, even more preferably at least 50% less, even more preferably at least 60% less, in particular at least 70% less, more in particular at least 80% less, for example at least 85% less, for example at least 90% less, for example at least 95% less, for example at least 100% less, for example at least 500% less, for example at least 1000% less of said peptide product. Preferably, analysis of the amount of peptide product is performed using LC/MS of said peptide product.

More preferably, the compound of interest comprises less of a tetrapeptide as preferably measured using the LC/MS analysis for cyclic tetrapeptide measurement as described in the experimental section and briefly outlined earlier in the specification. Preferably, the tetrapeptide is selected from the group of cyclic VVFF (SEQ ID NO: 5), cyclic VVFY (SEQ ID NO: 6), cyclic VVWY (SEQ ID NO: 23), cyclic VLYW (SEQ ID NO: 24), cyclic VLFY (SEQ ID NO: 25), cyclic LLFY (SEQ ID NO: 26), cyclic VVFW (SEQ ID NO: 27) and cyclic VLFF (SEQ ID NO: 28). More preferred tetrapeptides are cyclic VVFF (SEQ ID NO: 5) or cyclic VVFY (SEQ ID NO: 6). Preferably, the compound of interest comprises at least 20% less, more preferably at least 30% less, more preferably at least 40% less, even more preferably at least 50% less, even more preferably at least 60% less, in particular at least 70% less, more in particular at least 80% less, for example at least 85% less, for example at least 90% less, for example at least 95% less, for example at least 100% less, for example at least 500% less, for example at least 1000% less of said tetrapeptide.

The invention further relates to a microbial host cell that has been modified in its genome such that it results in a deficiency in the production of at least one non-ribosomal peptide synthase. The host cell can be any host cell and is preferably one as earlier defined herein. Said microbial host cell that has been modified in its genome such that it results in a deficiency in the production of at least one non-ribosomal peptide synthase is herein referred to as the host cell according to the invention.

Preferably, the deficiency in the production of the at least one non-ribosomal peptide synthase results in the reduction of the production of at least one peptide product, wherein said peptide product consists of at least two coupled amino acids, wherein said coupling is mediated by the at least one non-ribosomal peptide synthase; the amino acids of said peptide product may be modified, before and/or after coupling, in their chemical structure. Preferably, analysis of the amount of peptide product is performed using LC/MS.

More preferably, in the host cell according to the invention, the deficiency in the production of at the least one non-ribosomal peptide synthase results in the reduction of the production of a tetrapeptide as preferably measured using the LC/MS analysis for cyclic tetrapeptide measurement as described in the experimental section and briefly outlined earlier in the specification. Preferably, the tetrapeptide is selected from the group of cyclic VVFF (SEQ ID NO: 5), cyclic VVFY (SEQ ID NO: 6), cyclic VVWY (SEQ ID NO: 23), cyclic VLYW (SEQ ID NO: 24), cyclic VLFY (SEQ ID NO: 25), cyclic LLFY (SEQ ID NO: 26), cyclic VVFW (SEQ ID NO: 27) and cyclic VLFF (SEQ ID NO: 28). More preferred tetrapeptides are cyclic VVFF (SEQ ID NO: 5) or cyclic VVFY (SEQ ID NO: 6).

More preferably, the microbial host cell is an *Aspergillus* or *Penicillium*. Even more preferably, the microbial host cell is an *Aspergillus niger* or *Penicillium chrysogenum*. Most preferably, the microbial host cell is an *Aspergillus niger*.

When the compound of interest is a biopolymer as defined earlier herein, the microbial cell may already be capable to produce the biopolymer. The microbial cell may also be provided with a homologous or heterologous expression construct that encodes a polypeptide involved in the production of the compound of interest by the methods described earlier herein.

Preferably, the deficiency in the production of the at least one non-ribosomal peptide synthase by the microbial host cell according to the invention is a reduction in production of at least 20% more preferably by at least 30%, more preferably by at least 40%, even more preferably at least 50%, even more preferably at least 60%, in particular at least 70%, more in particular at least 80%, for example at least 85%, for example at least 90%, for example at least 95%, for example at least 100% as preferably measured using the LC/MS analysis for cyclic tetrapeptide measurement as described in the experimental section and briefly outlined earlier in the specification.

Preferably, the deficiency in the production of at the least one non-ribosomal peptide synthase results in the reduction of the production of at least one peptide product, wherein said peptide product consists of at least two coupled amino acids, wherein said coupling is mediated by the at least one non-ribosomal peptide synthase; the amino acids of said peptide product may be modified, before and/or after coupling, in their chemical structure. Preferably, the reduction in production of the peptide product is at least 20% more preferably by at least 30%, more preferably by at least 40%, even more preferably at least 50%, even more preferably at least 60%, in particular at least 70%, more in particular at least 80%, for example at least 85%, for example at least 90%, for example at least 95%, for example at least 100% as preferably measured using the LC/MS analysis of said peptide product.

More preferably, the deficiency in the production of the at least one non-ribosomal peptide synthase results in the reduction of the production of a tetrapeptide. Preferably, the reduction in production of tetrapeptide is at least 20% more preferably by at least 30%, more preferably by at least 40%, even more preferably at least 50%, even more preferably at least 60%, in particular at least 70%, more in particular at least 80%, for example at least 85%, for example at least 90%, for example at least 95%, for example at least 100% as preferably measured using the LC/MS analysis for cyclic tetrapeptide measurement as described in the experimental section and briefly outlined earlier in the specification. Preferably, the tetrapeptide is selected from the group of cyclic VVFF (SEQ ID NO: 5), cyclic VVFY (SEQ ID NO: 6), cyclic VVWY (SEQ ID NO: 23), cyclic VLYW (SEQ ID NO: 24), cyclic VLFY (SEQ ID NO: 25), cyclic LLFY (SEQ ID NO: 26), cyclic VVFW (SEQ ID NO: 27) and cyclic VLFF (SEQ ID NO: 28). More preferred tetrapeptides are cyclic VVFF (SEQ ID NO: 5) or cyclic VVFY (SEQ ID NO: 6).

Preferably, the modification in the genome of the microbial host cell according to the invention is a modification in the genome on at least one position of at least one nucleic acid sequence encoding a non-ribosomal peptide synthase having at least 35% identity, more preferably at least 40% identity, more preferably at least 45% identity, more preferably at least 50% identity, even more preferably at least 55% identity, even more preferably at least 60% identity, even more preferably at least 65% identity, even more preferably at least 70% identity, even more preferably at least 75% identity, even more preferably at least 80% identity, even more preferably at least 85% identity, even more preferably at least 90% identity, for example at least 91% identity, for example at least 92% identity, for example at least 93% identity, for example at least 94% identity, for example at least 95% identity, for example at least 96% identity, for example at least 97% identity, for example at least 98% identity, for example at least 99% identity, for example 100% identity with a polypeptide selected from the group consisting of the polypeptide according to SEQ ID NO: 4, the polypeptide according to SEQ ID NO: 10, the polypeptide according to SEQ ID NO: 14, the polypeptide according to SEQ ID NO: 18, the polypeptide according to SEQ ID NO: 22, the polypeptide according to SEQ ID NO: 34 and the polypeptide according to SEQ ID NO: 38 and/or the modification in the genome of the microbial host cell in the method according to the invention is a modification resulting in the reduction of the amount of at least one mRNA having at least 60% identity, even more preferably at least 65% identity, even more preferably at least 70% identity, even more preferably at least 75% identity, even more preferably at least 80% identity, even more preferably at least 85% identity, even more preferably at least 90% identity, for example at least 91% identity, for example at least 92% identity, for example at least 93% identity, for example at least 94% identity, for example at least 95% identity, for example at least 96% identity, for example at least 97% identity, for example at least 98% identity, for example at least 99% identity, for example 100% identity with an mRNA selected from the group of the mRNA according to SEQ ID NO: 3, the mRNA according to SEQ ID NO: 9, the mRNA according to SEQ ID NO: 13, the mRNA according to SEQ ID NO: 17, the mRNA according to SEQ ID NO: 21, the mRNA according to SEQ ID NO: 33 and the mRNA according to SEQ ID NO: 37. Preferably, the polypeptide is one of the polypeptide according to SEQ ID NO: 34 and the polypeptide according to SEQ ID NO: 38 and the mRNA is one of the mRNA according to SEQ ID NO: 33 and the mRNA according to SEQ ID NO: 37.

Therefore in a preferred embodiment, the modification in the genome of the microbial host cell used in the method according to the invention is a modification in the genome on at least one position of the nucleic acid sequence encoding a non-ribosomal peptide synthase having at least 35% identity, more preferably at least 40% identity, more preferably at least 45% identity, more preferably at least 50% identity, even more preferably at least 55% identity, even more preferably at least 60% identity, even more preferably at least 65% identity, even more preferably at least 70% identity, even more preferably at least 75% identity, even more preferably at least 80% identity, even more preferably at least 85% identity, even more preferably at least 90% identity, for example at least 91% identity, for example at least 92% identity, for example at least 93% identity, for example at least 94% identity, for example at least 95% identity, for example at least 96% identity, for example at least 97% identity, for example at least 98% identity, for example at least 99% identity, for example 100% identity with a polypeptide according to SEQ ID NO: 38 and/or the modification in the genome of the microbial host cell in the method according to the invention is a modification resulting in the reduction of the amount of mRNA having at least 60% identity, even more preferably at least 65% identity, even more preferably at least 70% identity, even more preferably at least 75% identity, even more preferably at least 80% identity, even more preferably at least 85% identity, even more preferably at least 90% identity, for example at least 91% identity, for example at least 92% identity, for example at least 93% identity, for example at least 94% identity, for example at least 95% identity, for example at least 96% identity, for example at least 97% identity, for example at least 98% identity, for example at least 99% identity, for example 100% identity with the mRNA according to SEQ ID NO: 37.

In another preferred embodiment, the modification in the genome of the microbial host cell used in the method according to the invention is a modification in the genome on at least one position of the nucleic acid sequence encoding a non-ribosomal peptide synthase having at least 35% identity, more preferably at least 40% identity, more preferably at least 45% identity, more preferably at least 50% identity, even more preferably at least 55% identity, even more preferably at least 60% identity, even more preferably at least 65% identity, even more preferably at least 70% identity, even more preferably at least 75% identity, even more preferably at least 80% identity, even more preferably at least 85% identity, even more preferably at least 90% identity, for example at least 91% identity, for example at least 92% identity, for example at least 93% identity, for example at least 94% identity, for example at least 95% identity, for example at least 96% identity, for example at least 97% identity, for example at least 98% identity, for example at least 99% identity, for example 100% identity with a polypeptide according to SEQ ID NO: 34 and/or the modification in the genome of the microbial host cell in the method according to the invention is a modification resulting in the reduction of the amount of mRNA having at least 60% identity, even more preferably at least 65% identity, even more preferably at least 70% identity, even more preferably at least 75% identity, even more preferably at least 80% identity, even more preferably at least 85% identity, even more preferably at least 90% identity, for example at least 91% identity, for example at least 92% identity, for example at least 93% identity, for example at least 94% identity, for example at least 95% identity, for example at least 96% identity, for example at least 97% identity, for example at least 98% identity, for example at least 99% identity, for example 100% identity with the mRNA according to SEQ ID NO: 33.

In an alternative embodiment the polypeptide is that according to SEQ ID NO: 22 and the mRNA is that according to SEQ ID NO: 21.

In another alternative embodiment the polypeptide is that according to SEQ ID NO: 18 and the mRNA is that according to SEQ ID NO: 17.

In another alternative embodiment the polypeptide is that according to SEQ ID NO: 14 and the mRNA is that according to SEQ ID NO: 13.

In another alternative embodiment the polypeptide is that according to SEQ ID NO: 10 and the mRNA is that according to SEQ ID NO: 9.

In another alternative embodiment the polypeptide is that according to SEQ ID NO: 4 and the mRNA is that according to SEQ ID NO: 3.

Preferably, said modification results in reduction in production of at least the non-ribosomal peptide synthase of at least 20% more preferably by at least 30%, more preferably by at least 40%, even more preferably at least 50%, even more preferably at least 60%, in particular at least 70%, more in particular at least 80%, for example at least 85%, for example at least 90%, for example at least 95%, for example at least 100% as preferably measured using the LC/MS analysis for cyclic tetrapeptide measurement as described in the experimental section and briefly outlined earlier in the specification. Preferably, the non-ribosomal polypeptide synthase is one of the polypeptide according to SEQ ID NO: 34 and the polypeptide according to SEQ ID NO: 38.

Preferably, said modification results in reduction of the amount of mRNA encoding for a non-ribosomal peptide synthase of at least 20% more preferably by at least 30%, more preferably by at least 40%, even more preferably at least 50%, even more preferably at least 60%, in particular at least 70%, more in particular at least 80%, for example at least 85%, for example at least 90%, for example at least 95%, for example at least 100%. Preferably, the mRNA is one of the mRNA according to SEQ ID NO: 33 and the polypeptide according to SEQ ID NO: 37.

Preferably, the deficiency in the production of at the least one non-ribosomal peptide synthase results in the reduction of the production of at least one peptide product, wherein said peptide product consists of at least two coupled amino acids, wherein said coupling is mediated by the at least one non-ribosomal peptide synthase; the amino acids of said peptide product may be modified, before and/or after coupling, in their chemical structure. Preferably, the reduction in production of the peptide product is at least 20% more preferably by at least 30%, more preferably by at least 40%, even more preferably at least 50%, even more preferably at least 60%, in particular at least 70%, more in particular at least 80%, for example at least 85%, for example at least 90%, for example at least 95%, for example at least 100% as preferably measured using the LC/MS analysis of said peptide product.

More preferably, the deficiency in the production of the non-ribosomal peptide synthase results in the reduction of the production of a tetrapeptide. Preferably, the reduction in production of the tetrapeptide is at least 20% more preferably by at least 30%, more preferably by at least 40%, even more preferably at least 50%, even more preferably at least 60%, in particular at least 70%, more in particular at least 80%, for example at least 85%, for example at least 90%, for example at least 95%, for example at least 100% as preferably measured using the LC/MS analysis for cyclic tetrapeptide measurement as described in the experimental section and briefly outlined earlier in the specification. Preferably, the tetrapeptide is selected from the group of cyclic VVFF (SEQ ID NO: 5), cyclic VVFY (SEQ ID NO: 6), cyclic VVWY (SEQ ID NO: 23), cyclic VLYW (SEQ ID NO: 24), cyclic VLFY (SEQ ID NO: 25), cyclic LLFY (SEQ ID NO: 26), cyclic VVFW (SEQ ID NO: 27) and cyclic VLFF (SEQ ID NO: 28). More preferred tetrapeptides are cyclic VVFF (SEQ ID NO: 5) or cyclic VVFY (SEQ ID NO: 6).

The invention further relates to a method for the preparation of the microbial host cell according to the invention, i.e. said host cell being deficient in the production of at least one non-ribosomal peptide synthase as described earlier herein, said method preferably comprising modification of the genome of a parent host cell as described earlier herein.

PREFERRED EMBODIMENTS OF THE INVENTION

1. A method for the production of a compound of interest by microbial fermentation comprising:
   a. providing a microbial host cell,
   b. culturing said microbial host cell under conditions conducive to the expression of the compound of interest,
   c. isolating the compound of interest from the culture medium,
   wherein said microbial host cell has been modified in its genome such that it results in a deficiency in the production of at least one non-ribosomal peptide synthase.
2. The method according to embodiment 1, wherein said microbial host cell has been modified in its genome on at least one position of at least one nucleic acid sequence encoding a non-ribosomal peptide synthase having at least 30% identity with a polypeptide selected from the group consisting of the polypeptide according to SEQ ID NO: 38, the polypeptide according to SEQ ID NO: 34, the polypeptide according to SEQ ID NO: 10, the polypeptide according to SEQ ID NO: 14, the polypeptide according to SEQ ID NO: 18, the polypeptide according to SEQ ID NO: 22, and the polypeptide according to SEQ ID NO: 4 and/or wherein said microbial host cell has been modified in its genome such that it results in a reduction of the amount of at least one mRNA having at least 60% identity with a mRNA selected from the group of the mRNA according to SEQ ID NO: 37, the mRNA according to SEQ ID NO: 33, the mRNA according to SEQ ID NO: 9, the mRNA according to SEQ ID NO: 13, the mRNA according to SEQ ID NO: 17, the mRNA according to SEQ ID NO: 21, and the mRNA according to SEQ ID NO: 3.
3. The method according to embodiment 1 or 2 wherein the polypeptide is one of the polypeptide according to SEQ ID NO: 38 or the polypeptide according to SEQ ID NO: 34 and/or the mRNA is one of the mRNA according to SEQ ID NO: 37 or the mRNA according to SEQ ID NO: 33.
4. The method according to any one of embodiments 1 to 3, wherein the deficiency in the production of the at least one non-ribosomal peptide synthase is a reduction in production of at least 40%.
5. The method according to any one of embodiments 1 to 4 wherein the deficiency in the production of at the least one non-ribosomal peptide synthase results in the reduction of the production of at least one peptide product, wherein said peptide product consists of at least two coupled amino acids, wherein said coupling is mediated by the at least one non-ribosomal peptide synthase; and wherein the amino acids of said peptide product may be optionally modified, before and/or after coupling, in their chemical structure.
6. The method according to embodiment 5, wherein the deficiency in the production of the at least one non-ribosomal peptide synthase results in the reduction of the production of a tetrapeptide, preferably a cyclic tetrapeptide.
7. The method according to embodiment 6, wherein the tetrapeptide is selected from the group of cyclic VVFF (SEQ ID NO: 5), cyclic VVFY (SEQ ID NO: 6), cyclic VVWY (SEQ ID NO: 23), cyclic VLYW (SEQ ID NO: 24), cyclic VLFY (SEQ ID NO: 25), cyclic LLFY (SEQ ID NO: 26), cyclic VVFW (SEQ ID NO: 27) and cyclic VLFF (SEQ ID NO: 28), more preferably the tetrapeptide is selected from the group of cyclic VVFF (SEQ ID NO: 5) or cyclic VVFY (SEQ ID NO: 6).
8. The method according to any one of embodiments 5 to 7 wherein the reduction in the production of the peptide product, preferably the reduction in the production of a tetrapeptide, more preferably the reduction in the production of the cyclic tetrapeptide is at least 20%.
9. The method according to any of embodiments 1 to 8, wherein the microbial host cell is an eukaryotic cell, more preferably the microbial host cell is a fungal cell, even more preferably the microbial host cell is a filamentous fungus.
10. The method according to embodiment 9, wherein the filamentous fungus is an *Aspergillus, Acremonium, Thielavia, Chrysosporium, Myceliophthora, Penicillium, Talaromyces, Fusarium* or *Trichoderma*, preferably a species of *Aspergillus niger, Aspergillus awamori, Aspergillus foetidus, Aspergillus sojae, Aspergillus fumigatus, Talaromyces emersonii, Aspergillus oryzae, Chrysosporium lucknowense, Fusarium oxysporum, Trichoderma reesei, Acremonium alabamense, Myceliophthora thermophila, Thielavia terrestris* or *Penicillium chrysogenum*.
11. The method according to embodiment 10, wherein the microbial host cell belongs to the genus *Aspergillus* or *Penicillium*, more preferably the microbial host cell is an *Aspergillus niger* or *Penicillium chrysogenum*, most preferably the microbial host cell is an *Aspergillus niger*.
12. The method according to any one of embodiments 9 to 11 wherein the host cell is a filamentous fungal host cell which additionally comprises one or more modifications in its genome in a polynucleotide encoding a product selected from the group of glucoamylase (glaA), acid stable alpha-amylase (amyA), neutral alpha-amylase (amyBI and amyBII), oxalic acid hydrolase (oahA), a toxin, preferably ochratoxin and/or fumonisin, and protease transcriptional regulator prtT such that the host cell is deficient in at least one product encoded by the polynucleotide comprising the modification.

13. The method according to any one of embodiments 1 to 12 wherein the host cell additionally comprises a disruption of the pepA gene encoding the major extracellular aspartic protease PepA.

14. The method according to any one of embodiments 1 to 13 wherein the host cell additionally comprises a disruption of the hdfA gene.

15. The method according to any one of embodiments 1 to 14 wherein the host cell additionally comprises at least two substantially homologous DNA domains suitable for integration of one or more copies of a polynucleotide encoding a compound of interest wherein at least one of the at least two substantially homologous DNA domains is adapted to have enhanced integration preference for the polynucleotide encoding a compound of interest compared to the substantially homologous DNA domain it originates from, and wherein the substantially homologous DNA domain where the adapted substantially homologous DNA domain originates from has a gene conversion frequency that is at least 10% higher than one of the other of the at least two substantially homologous DNA domains.

16. The method according to embodiment 15 wherein the host cell, preferably an *A. niger* host cell, is a host cell, comprising two or more amplicons, preferably two or more ΔglaA amplicons and wherein the amplicon which has the highest frequency of gene conversion, has been adapted to have enhanced integration preference for the polynucleotide encoding a compound of interest compared to the amplicon it originates from.

17. The method according to any one of embodiments 1 to 16 wherein the host cell additionally comprises a modification of Sec61, preferably the SEC 61 modification is the S376W mutation in which Serine 376 is replaced by Tryptophan.

18. The method according to any one of embodiments 1 to 17 wherein the compound of interest is a biological compound selected from the group consisting of biomass, a biopolymer, a metabolite, preferably a biopolymer selected from a nucleic acid, polyamine, polyol, polypeptide (such as a protein, preferably an enzyme), or polyamide, or polysaccharide or a metabolite selected from a primary or secondary metabolite.

19. A microbial host cell that has been modified in its genome such that it results in a deficiency in the production of at least one non-ribosomal peptide synthase.

20. The microbial host cell according to embodiment 19, wherein said microbial host cell has been modified in its genome on at least one position of a at least one nucleic acid sequence encoding a non-ribosomal peptide synthase having at least 30% identity with a polypeptide selected from the group consisting of the polypeptide according to SEQ ID NO: 38, the polypeptide according to SEQ ID NO: 34, the polypeptide according to SEQ ID NO: 10, the polypeptide according to SEQ ID NO: 14, the polypeptide according to SEQ ID NO: 18, the polypeptide according to SEQ ID NO: 22, and the polypeptide according to SEQ ID NO: 4 and/or wherein said microbial host cell has been modified in its genome such that it results in a reduction of the amount of at least one mRNA having at least 60% identity with an mRNA selected from the group of the mRNA according to SEQ ID NO: 37, the mRNA according to SEQ ID NO: 33, the mRNA according to SEQ ID NO: 9, the mRNA according to SEQ ID NO: 13, the mRNA according to SEQ ID NO: 17, the mRNA according to SEQ ID NO: 21, and the mRNA according to SEQ ID NO: 3.

21. The microbial host cell according to embodiment 20 wherein the polypeptide is one of the polypeptide according to SEQ ID NO: 38 or the polypeptide according to SEQ ID NO: 34 and/or the mRNA is one of the mRNA according to SEQ ID NO: 37 or the mRNA according to SEQ ID NO: 33.

22. The microbial host cell according to any one of embodiments 19 to 21, wherein the deficiency in the production of the at least one non-ribosomal peptide synthase by the microbial host cell is a reduction in production of at least 40%.

23. The microbial host cells according to any one of embodiments 19 to 22 wherein the deficiency in the production of the at least one non-ribosomal peptide synthase results in the reduction of the production of at least one peptide product, wherein said peptide product consists of at least two coupled amino acids, wherein said coupling is mediated by the at least one non-ribosomal peptide synthase; and wherein the amino acids of said peptide product may optionally be modified, before and/or after coupling, in their chemical structure.

24. A microbial host cell according to any one of embodiments 19 to 23 wherein the deficiency in the production of at the least one non-ribosomal peptide synthase results in the reduction of the production of a tetrapeptide, preferably a cyclic tetrapeptide, more preferably the tetrapeptide is selected from the group of cyclic VVFF (SEQ ID NO: 5), cyclic VVFY (SEQ ID NO: 6), cyclic VVWY (SEQ ID NO: 23), cyclic VLYW (SEQ ID NO: 24), cyclic VLFY (SEQ ID NO: 25), cyclic LLFY (SEQ ID NO: 26), cyclic VVFW (SEQ ID NO: 27) and cyclic VLFF (SEQ ID NO: 28), more preferably the tetrapeptide is cyclic VVFF (SEQ ID NO: 5) or cyclic VVFY (SEQ ID NO: 6).

25. A microbial host cell according to any one of embodiments 23 or 24 wherein the reduction in the production of the peptide product, preferably the reduction in the production of a tetrapeptide, more preferably the reduction in the production of the cyclic tetrapeptide is at least 20%.

26. The microbial host cell according to any one of embodiments 19 to 25 wherein the microbial host cell is a filamentous fungus, preferably a filamentous fungus selected from *Aspergillus, Acremonium, Myceliophthora, Thielavia Chrysosporium, Penicillium, Talaromyces, Fusarium* or *Trichoderma*, preferably a species of *Aspergillus niger, Aspergillus awamori, Aspergillus foetidus, Aspergillus sojae, Aspergillus fumigatus, Talaromyces emersonii, Aspergillus oryzae, Acremonium alabamense, Myceliophthora thermophila, Thielavia terrestris Chrysosporium lucknowense, Fusarium oxysporum, Trichoderma reesei* or *Penicillium chrysogenum*.

27. The microbial host cell according to embodiment 26, wherein the filamentous fungus belongs to the genus *Aspergillus* or *Penicillium*, more preferably the microbial host cell is an *Aspergillus niger* or *Penicillium chrysogenum*, most preferably the microbial host cell is an *Aspergillus niger*.

28. The microbial host cell according to any one of embodiments 26 or 27 wherein the host cell is a filamentous fungal host cell which additionally comprises one or more modifications in its genome in a polynucleotide encoding a product selected from the group of glucoamylase (glaA), acid stable alpha-amylase (amyA), neutral alpha-amylase (amyBI and amyBII), oxalic acid hydrolase (oahA), a toxin, preferably ochratoxin and/or fumonisin, and protease transcriptional regulator prtT such that the host cell is deficient in at least one product encoded by the polynucleotide comprising the modification.

29. The microbial host cell according to any one of embodiments 26 to 28 wherein the host cell additionally comprises a disruption of the pepA gene encoding the major extracellular aspartic protease PepA.

30. The microbial host cell according to any one of embodiments 26 to 29 wherein the host cell additionally comprises a disruption of the hdfA gene.

31. The microbial host cell according to any one of embodiments 26 to 30 wherein the host cell additionally comprises at least two substantially homologous DNA domains suitable for integration of one or more copies of a polynucleotide encoding a compound of interest wherein at least one of the at least two substantially homologous DNA domains is adapted to have enhanced integration preference for the polynucleotide encoding a compound of interest compared to the substantially homologous DNA domain it originates from, and wherein the substantially homologous DNA domain where the adapted substantially homologous DNA domain originates from has a gene conversion frequency that is at least 10% higher than one of the other of the at least two substantially homologous DNA domains.

32. The microbial host cell according to embodiment 31 wherein the host cell is a host cell, preferably an *A. niger* host cell, comprising two or more amplicons, preferably two or more ΔglaA amplicons, and wherein the amplicon which has the highest frequency of gene conversion, has been adapted to have enhanced integration preference for the polynucleotide encoding a compound of interest compared to the amplicon it originates from.

33. The microbial host cell according to any one of embodiments 26 to 32 wherein the host cell additionally comprises a modification of Sec61, preferably the SEC 61 modification is the S376W mutation in which Serine 376 is replaced by Tryptophan.

34. A compound of interest comprising less of at least one peptide product as compared to said compound of interest being produced under identical conditions in a parent microbial host cell that has not been modified in its genome such that it results in a deficiency in the production of at least one non-ribosomal peptide synthase, wherein said peptide product consists of at least two coupled amino acids, wherein said coupling is mediated by the at least one non-ribosomal peptide synthase; and wherein the amino acids of said peptide product may be optionally modified, before and/or after coupling, in their chemical structure.

35. A compound of interest according to embodiment 34 which is a biological compound selected from the group consisting of biomass, a biopolymer, a metabolite, preferably a biopolymer selected from a nucleic acid, polyamine, polyol, polypeptide (such as a protein, preferably an enzyme) or polyamide, or polysaccharide or a metabolite selected from a primary or secondary metabolite.

36. A compound of interest according to any one of embodiments 34 or 35 which comprises less of a tetrapeptide, preferably less of a cyclic tetrapeptide, more preferably less of a tetrapeptide selected from the group of cyclic VVFF (SEQ ID NO: 5), cyclic VVFY (SEQ ID NO: 6), cyclic VVWY (SEQ ID NO: 23), cyclic VLYW (SEQ ID NO: 24), cyclic VLFY (SEQ ID NO: 25), cyclic LLFY (SEQ ID NO: 26), cyclic VVFW (SEQ ID NO: 27) and cyclic VLFF (SEQ ID NO: 28), more preferably less of a tetrapeptide which is cyclic VVFF (SEQ ID NO: 5) or cyclic VVFY (SEQ ID NO: 6).

37. Method for the preparation of the microbial host cell according to any one of embodiments 19 to 33, said method comprising modification of the genome of a parent host cell such that it results in a deficiency in the production of at least one non-ribosomal peptide synthase.

Strains

WT 1: This *Aspergillus niger* strain is used as a wild-type strain. This strain is deposited at the CBS Institute under the deposit number CBS 513.88.

WT 2: This *A. niger* strain is a WT 1 strain comprising a deletion of the gene encoding glucoamylase (glaA). WT 2 was constructed by using the "MARKER-GENE FREE" approach as described in EP 0 635 574 B1. In this patent it is extensively described how to delete glaA specific DNA sequences in the genome of CBS 513.88. The procedure resulted in a MARKER-GENE FREE ΔglaA recombinant *A. niger* CBS 513.88 strain, possessing finally no foreign DNA sequences at all.

WT 3: This *A. niger* strain is a WT 2 strain comprising a deletion of the pepA gene encoding the major extracellular aspartic protease PepA, as described by van den Hombergh et al. (van den Hombergh J P, Sollewijn Gelpke M D, van de Vondervoort P J, Buxton F P, Visser J. (1997)—Disruption of three acid proteases in *Aspergillus niger*—effects on protease spectrum, intracellular proteolysis, and degradation of target proteins—Eur J. Biochem. 247(2): 605-13). The procedure resulted in a MARKER-GENE FREE WT 3 strain with the pepA gene inactivated in the WT 2 strain background.

WT 4: This *A. niger* strain is a marker-gene free WT 3 strain comprising a deletion of the hdfA gene, using the method as earlier described in detail in WO05/095624.

Wisconsin 54-1255 (ATCC 28089): This is the *Penicillium chrysogenum* strain used in examples 6 and 7.

Molecular Biology Techniques

In these strains, using molecular biology techniques known to the skilled person (see: Sambrook & Russell, *Molecular Cloning: A Laboratory Manual,* 3rd Ed., CSHL Press, Cold Spring Harbor, N.Y., 2001), several genes were over expressed and others were down regulated as described below. Examples of the general design of expression vectors for gene over expression and disruption vectors for down-regulation, transformation, use of markers and selective media can be found in WO199846772, WO199932617, WO2001121779, WO2005095624, EP 635574B and WO2005100573.

*A. niger* Shake Flask Fermentations

*A. niger* strains were pre-cultured and cultured at 34° C. and 170 rpm as described in WO2010/102982. Pre-culture was in 20 ml CSL pre-culture medium and after overnight growth 10 ml of this culture was transferred to 100 ml fermentation medium (FM) as described in more detail in WO2010/102982 with a cultivation time as indicated.

Sample Preparation for LC/MS Analysis of a Broth Sample.

In this analysis of the broth for cyclic peptides, the supernatant and the pellet fraction are separated and analyzed separately. Prior to LC/MS analysis, 2 ml of a broth sample was centrifuged (13,000 rpm) and the supernatant and pellet were separated. The obtained pellets were washed 3 times with 2 ml MilliQ water. Then, 1 ml of TFA was added. The samples were homogenized and centrifuged (at 13,000 rpm). Due to the limited solubility of the particular cyclic peptides in a mixture of water:acetonitrile:formic acid (MQ:ACN:FA 50:50:0.1) and good solubility in TFA, all subsequent dilutions of the supernatant and pellet sample are performed in TFA. Before analysis, a final dilution step of 100× in starting eluens MilliQ water:acetonitrile: formic acid 50:50:0.1 (v/v/v) is performed. All samples are spiked with the internal standard VV-Dphe-Y.

LC/MS Analysis for Cyclic Tetrapeptide Measurement

A LTQ-Orbitrap mass spectrometer (ThermoElectron™, Breda, the Netherlands), operating in positive ionization mode, coupled to a Accela pump (ThermoFisher Scientific™, Breda, the Netherlands) was used for the characterization and measurement of the cyclic peptides VVFF (SEQ ID NO: 5) (M=492.27366 Da) and VVFY (SEQ ID NO: 6) (M=508.26857 Da). The cyclic peptides were separated using a Inertsil ODS-3 3μ 2.1*150 mm column (GL Sciences Inc. C/N 5020-04415) in combination with a gradient of 0.1% formic acid in Milli Q water (Millipore, Bedford, Mass., USA; Solution A) and 0.1% formic acid in acetonitrile (Solution B) for elution. The gradient started at 50% of Solution B for two minutes and was increased to 80% of solution B in 10 minutes and was kept at the latter ratio for another 2 minutes. The injection volume used was 25 microliters, the flow rate was 200 microliter per minute and the column temperature was maintained at 40° C. Detailed information on the individual cyclic peptides was obtained by full scan analysis in the Orbitrap for accurate mass determination and MS/MS analysis in the LTQ for amino acid sequence information.

A standard containing both VVFF (SEQ ID NO: 5) and VVFY (SEQ ID NO: 6) was dissolved in trifluoroacetic acid (TFA) and further diluted in MilliQ water:acetonitrile:formic acid 50:50:0.1 (v/v/v). The TFA was used because cyclic peptides were observed to be practically insoluble in MilliQ water. The obtained solution was used to tune for optimal sensitivity in MS mode and for optimal fragmentation in MS/MS mode, performing constant infusion of 20 μg/ml, resulting in optimal collision energy of about 20% in MS/MS mode. Cyclic VVFF (cVVFF—SEQ ID NO: 5) (m/z 493) is characterized in MS/MS mode by the product ions having a m/z value of 465, 394, 346, and 247. cVVFY (SEQ ID NO: 6) (m/z 509) is characterized in MS/MS mode by the product ions having a m/z value of 481, 410, 346, and 247. cVVWY (SEQ ID NO: 23) (m/z 548) is characterized in MS/MS mode by the product ions having a m/z value of 520, 449, 385, and 286. cVLYW (SEQ ID NO: 24) (m/z 562) is characterized in MS/MS mode by the product ions having a m/z value of 534, 449, 399, and 350. cVLFY (SEQ ID NO: 25) (m/z 523) is characterized in MS/MS mode by the product ions having a m/z value of 495, 424, 410, 360 and 311. cLLFY (SEQ ID NO: 26) (m/z 537) is characterized in MS/MS mode by the product ions having a m/z value of 509, 424, 374, and 311. cVVFW (SEQ ID NO: 27) (m/z 532) is characterized in MS/MS mode by the product ions having a m/z value of 504, 433, 385, and 334. cVLFF (SEQ ID NO: 28) (m/z 507) is characterized in MS/MS mode by the product ions having a m/z value of 479, 408, 394, 360 and 295.

Enzyme Activity Measurements

To determine phospholipase PLA2 activity (PLA2) in *Aspergillus niger* culture broth spectrophotometrically, an artificial substrate is used: 1,2-dithiodioctanoyl phophatidylcholine (diC8, substrate). More details of this assay are described in WO2006/040312.

Lipase activity can be measured as described under "activity measurements" section of WO2009/106575.

Glucose oxidase activity was measured as described in Witteveen et al. 1990, "Glucose oxidase overproducing and negative mutants of *Aspergillus* niger", Appl Microbiol Biotechnol 33:683-686.

Example 1

Construction of Enzyme Producing *Aspergillus niger* Strains

The *Penicillium chrysogenum* glucose oxidase enzyme (with a codon pair optimized coding sequence as depicted in SEQ ID NO: 29, and a protein sequence as depicted in SEQ ID NO: 30), a lipolytic L01enzyme as detailed in WO2009/106575, porcine phospholipase A2 (PLA2) protein were selected as model proteins for enzyme expression in the *A. niger* WT 4.

Figure 5:
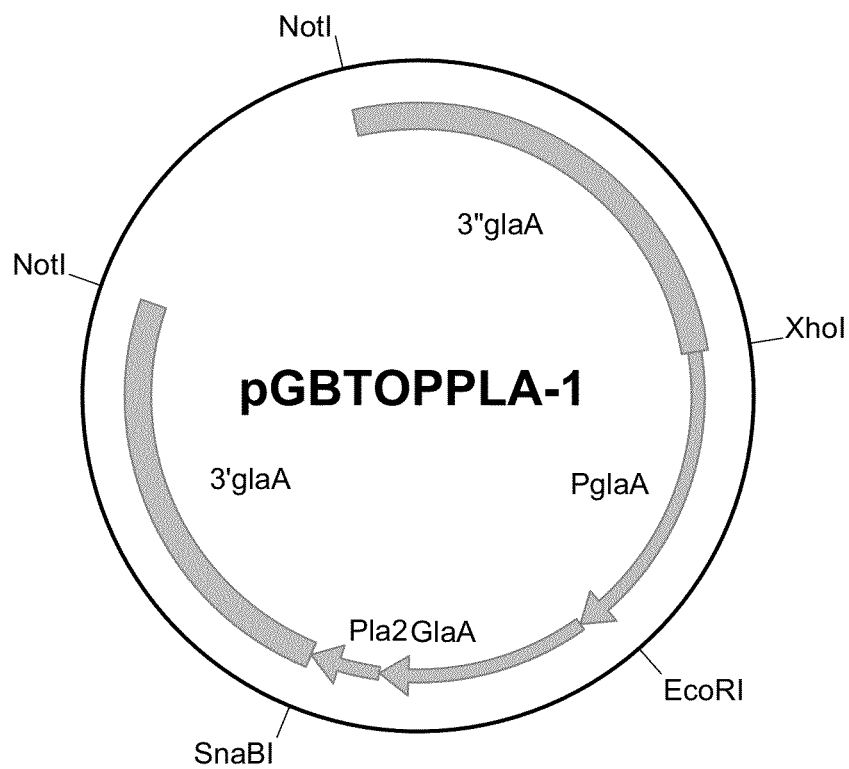
FIG. 5 depicts pGBTOPPLA-1, the plasmid used for the expression of porcine phospholipase $A_2$.

The *P. chrysogenum* gox gene and the gene encoding the lipolytic enzyme were cloned into an *A. niger* pGBTOP— expression vector using the techniques as described in WO 98/46772 and WO 99/32617, under the control of the glucoamylase promoter, yielding pGBTOPGOX-1 and pGBTOPLIP-1. The fragment for overexpression of PLA2 is made as a fusion of propLA2 with a native glucoamylase A gene of *A. niger* and is prepared as described by Roberts et al. (Roberts I. N., Jeenes D. J., MacKenzie D. A., Wilkinson A. P., Sumner I. G. and Archer D. B. (1992)—Heterologous gene expression in *Aspergillus niger*: a glucoamylase-porcine pancreatic phospholipase A₂ fusion protein is secreted and processed to yield mature enzyme. Gene 122: 155-161). The fusion protein contains a kex1 splicing site in order to be processed in the Golgi. This glaA-pla2 fusion gene is cloned into an *A. niger* pGBTOPPLA-1 expression vector (FIG. 5) using the same techniques as described in WO 98/46772 and WO 99/32617.

Enzyme producing strains for the glucose oxidase, the lipolytic enzyme and the glucoamylase-porcine pancreatic phospholipase A₂ fusion protein were constructed by co-transformation of the WT 4 strain with the amdS selectable marker-gene containing vector pGBAAS-1 and the pGBTOPGOX-1, pGBTOPLIP-1 and pGBTOPPLA-1 vector, respectively and subsequent selection of transformants. The transformation and counterselection procedure (as described in WO98/46772 and WO99/32617), followed by selection of strains resulted in (multicopy) strains producing glucose oxidase, lipase and glucoamylase-porcine pancreatic phospholipase A₂ fusion protein producing strains. For each strain background, 1 high-copy enzyme-producing strain for the WT 4 background was selected and named PGOX-1, LIP-1 and PLA-1. These strains were used as the respective enzyme producing strains in subsequent experiments.

Example 2

Construction Approach of *Aspergillus niger* GBA Strains, Containing Deletions

Figure 2:
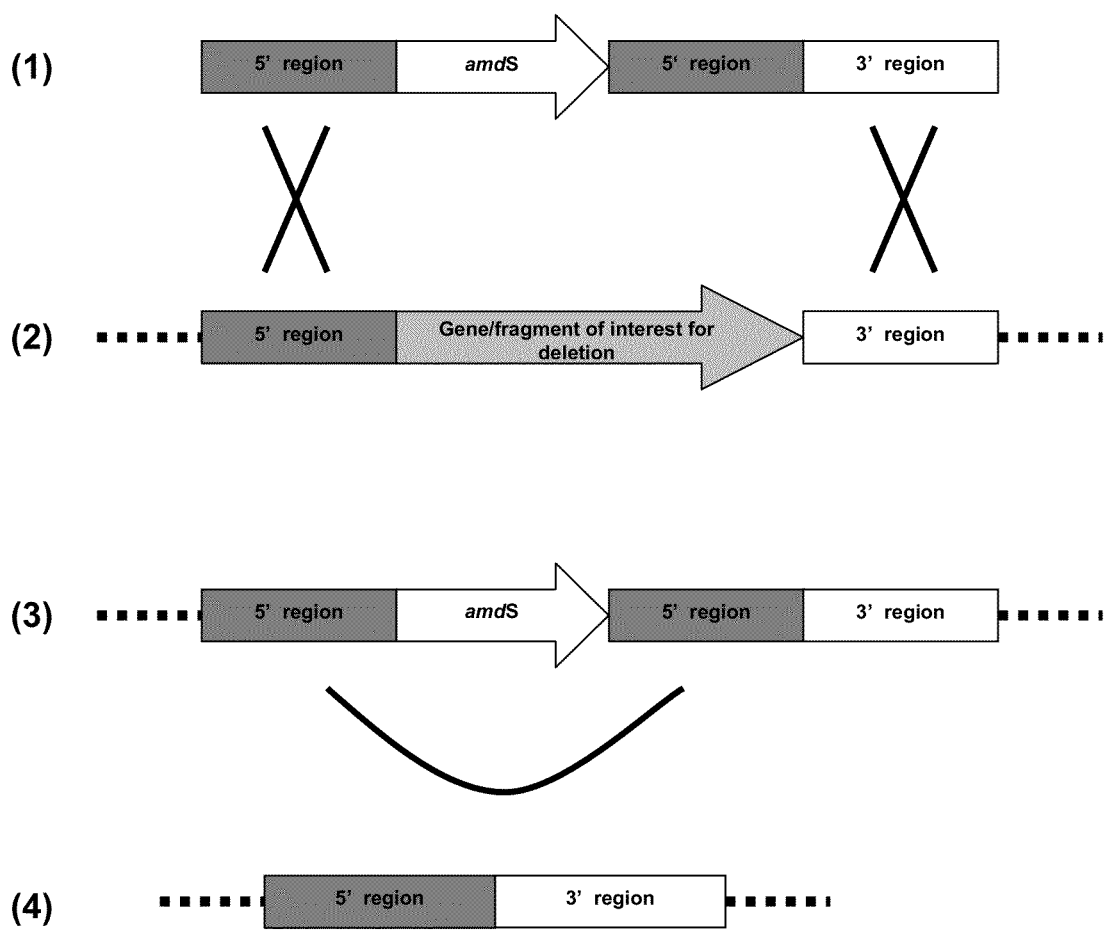
FIG. 2 depicts the general strategy to modify the genome of a microbial host cell by gene replacement mediated deletion of a gene or gene-fragment. The DNA construct used comprises the amdS selection marker flanked by homologous regions (5' and 3') of the gene to be deleted (1). The construct integrates by double homologous recombination (X) at the corresponding genomic locus (2) and replaces the genomic gene copy (gene replacement) (3). Subsequently, recombination over the direct repeats (U) removes the amdS marker, resulting in precise excision of the gene or gene fragment to be deleted (4).

All gene replacement vectors described and used below, were designed according to known principles and constructed according to routine cloning procedures. The use of general cloning vector pGBDEL (FIG. 1) for constructing deletion vectors and the counterselection procedure were a.o. described in WO06/040312, EP635574B and WO 98/46772. In essence, deletion vectors comprise approximately 1-2 kb targeting regions for the respective ORF sequence, to target for homologous recombination at the predestined genomic locus. In addition, they contain the *A. nidulans* bi-directional amdS selection marker gene for transformation, in-between direct repeats. The removal of the amdS gene can be done by so-called counter selection, plating on fluoro-acetamide media, resulting in the selection of marker-gene-free strains. Using this strategy of transformation and subsequent counterselection, which is also described as the "MARKER-GENE FREE" approach in EP 0 635 574, the amdS marker can be used indefinitely in strain modification programs. This general procedure for gene disruption as described here above is depicted in FIG. 2.

Figure 3:
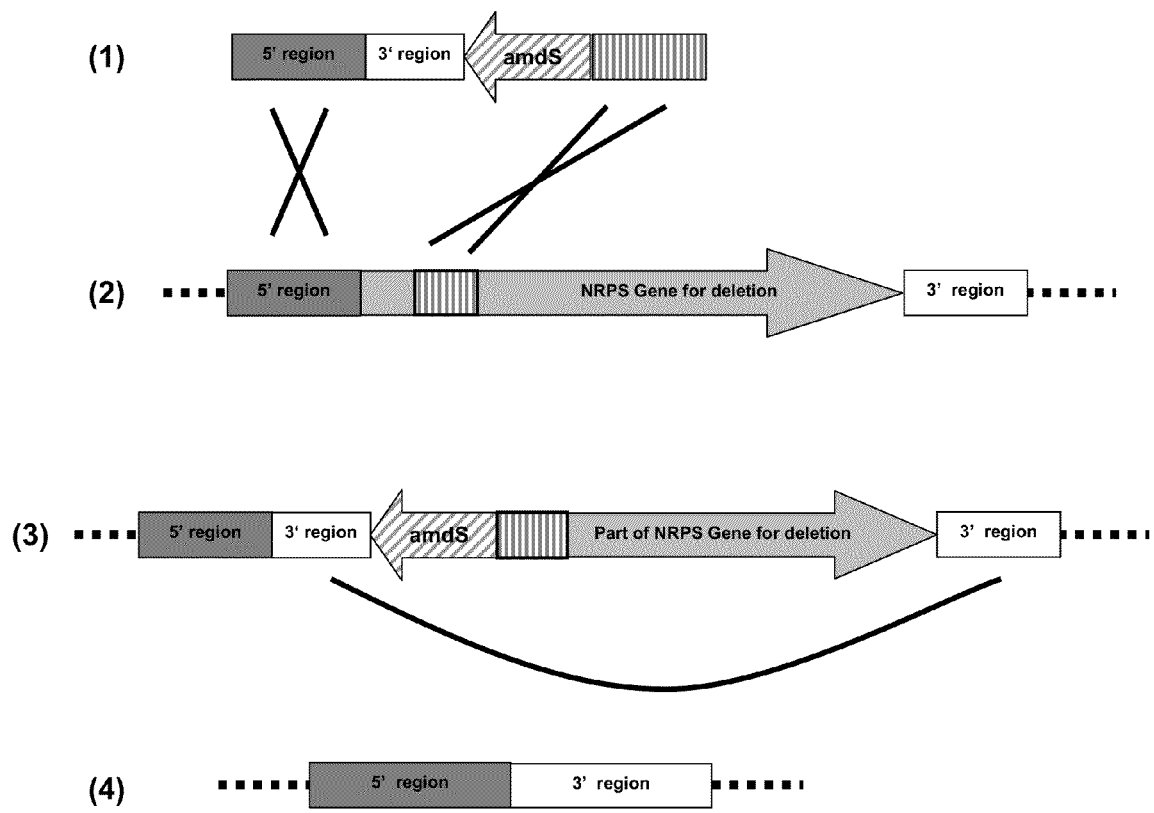
FIG. 3 depicts a modification of the deletion strategy according to FIG. 2. This modified strategy that facilitates the deletion of large sequences. Targeting regions for gene disruption are the 5' part of the gene and an internal fragment of the NRPS gene to be disrupted. The repeat sequence for removal of the marker contains a sequence homologous to the 3' part of the gene to be disrupted (1). A linear DNA fragment build up like this integrates into the genome at the homologous locus at the targeting sequences by a double cross-over, thus substituting the 5' part of the gene to be deleted by the amdS gene (2). After transformation, the direct repeats generated, being the 3' part of the gene to be disrupted allow for the removal of the selection marker by a (second) homologous recombination event (3), by which an additional fragment of the gene to be removed is deleted (4).

A slightly modified method is applied for gene deletion of a gene of the invention as used in the examples herein (as depicted in FIG. 3). Since NRPS genes are very large sequences, targeting regions for gene disruption are the 5' region of the gene and an internal fragment of the NRPS gene to be disrupted. The repeat sequence for removal of the marker contains a sequence homologous to the 3' region of the gene to be disrupted. A linear DNA fragment build up like this integrates into the genome at the homologous locus at the targeting sequences by a double cross-over (FIG. 3), thus substituting the 5' region of the gene to be deleted by the amdS gene. After transformation, the direct repeats generated, being the 3' region of the gene to be deleted allow for the removal of the selection marker gene by a (second) homologous recombination event, by which an additional fragment of the gene to be removed is deleted. Using the modified strategy as depicted in FIG. 3, large gene fragments or genomic regions can be deleted with sufficient frequency in a genomic sequence. The knock-out and counter selection procedure as depicted in FIG. 2 and FIG. 3 have a different intermediate result at genomic scale but the final genomic makeup after counterselection is identical for both methods.

Example 3

Figure 4:
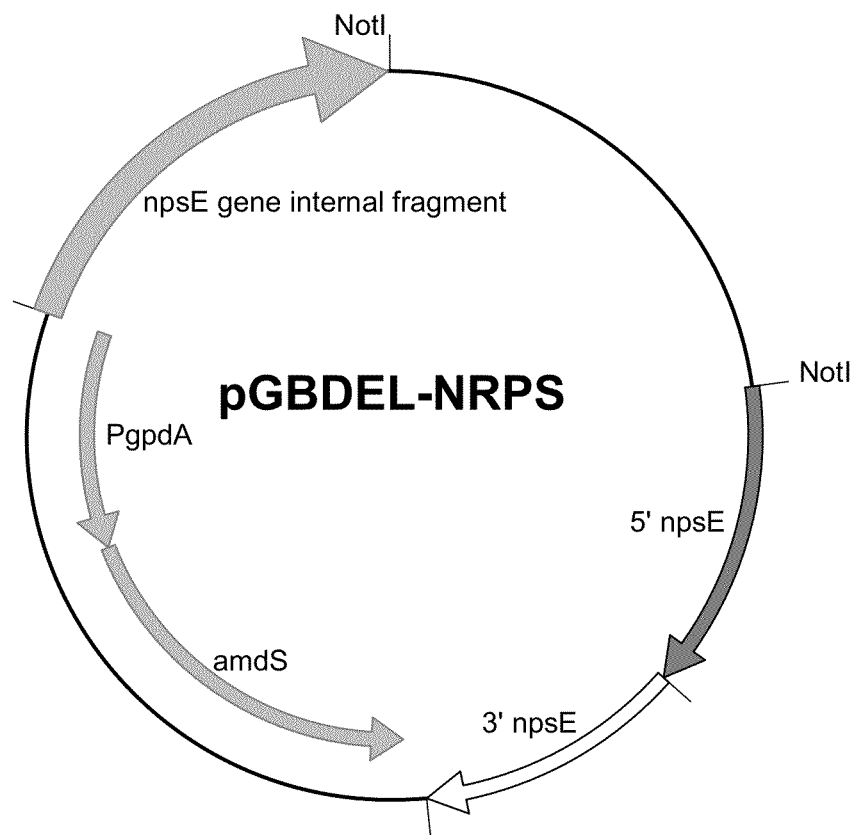
FIG. 4 depicts pGBDEL-NRPS, the plasmid used for deletion of the NRPS encoding npsE gene with a layout representative for other deletion constructs.

Construction of an *Aspergillus niger* Strain of the Invention with a Gene Encoding an NRPS Enzyme Disrupted To be able to disrupt the gene (npsE) encoding a non-ribosomal peptide synthase (with a genomic sequence as depicted in SEQ ID NO: 35, the coding sequence depicted in SEQ ID NO: 36, the mRNA depicted in SEQ ID NO: 37 and the nrps protein depicted in SEQ ID NO: 38), a gene replacement vector was designed as described above in example 2. Vector pGBDEL-NRPS was constructed by DNA synthesis and comprised approximately 1.3 kb targeting regions of the npsE promoter, part of the npsE ORF and 3' region of npsE for homologous recombination, with a layout and orientation of fragments as shown in FIG. 4. This pGBDEL-NRPS vector was linearized and used to transform *Aspergillus niger* strains WT 4, PGOX-1, LIP-1 and PLA-1. After selection of a correct transformant with an integration of the fragment at the npsE locus, and subsequently counterselection, strains WT 4_NPS_E, PGOX-1_NPS_E, LIP-1_NPS_E and PLA-1_NPS_E were selected as representative strains with the npsE gene inactivated in their respective strain backgrounds. This is a typical example depicting the disruption of npsE in a strain background. The same method can be used for the disruption of the npsA, npsB, npsC, and/or npsD genes.

Example 4

Analysis of *Aspergillus niger* Strains of the Invention with a Gene Encoding an NRPS Enzyme Disrupted and their Enzyme Products Produced Upon the expression of enzymes (for example PGOX, LIP, PLA), in WT4 strains where no disruption of npsE has been effected the level of cyclic tetrapeptides produced and measured in the supernatant can be elevated. Analysis of mycelial pellets and medium supernatants for a number of strains in the WT 4 genetic background indicates that disruption of npsE (SEQ ID No. 35-38) results in a drastic reduction of cyclic tetrapeptides VVFF and VVFY in both the mycelial fraction and the medium supernatant. All results are shown in Table 1. Analysis of cyclic tetrapeptide production in npsE disruption strains in the respective enzyme (PGOX, LIP, PLA) producing backgrounds reveals that upon disruption of the npsE gene of the invention, again the level of cyclic tetrapeptides produced in the extracellular supernatant is reduced drastically. This shows that upon disruption of npsE, cyclic tetrapeptide production is reduced drastically irrespective of the enzyme product produced by the strain.

TABLE 1

Cyclic tetrapeptide measurements of supernatant and biomass (mycelial pellet) after shake flask fermentation in FM medium

| | Supernatant | | Mycelial pellet | |
| --- | --- | --- | --- | --- |
| | | | VVFY | VVFF |
| Strain (day 4) | VVFY m/z 509 (mg/ml) | VVFF m/z 493 (mg/ml) | m/z 509 (mg/ml) | m/z 493 (mg/ml) |
| CBS513.88 | 0.005 | 0.004 | 0.010 | 0.012 |
| WT 4 | 0.004 | 0.004 | 0.015 | 0.009 |
| WT 4_NPS_E | <0.001 | <0.001 | <0.001 | <0.001 |
| PGOX-1 | 0.12 | 0.09 | 0.003 | 0.004 |
| LIP-1 | 0.28 | 0.26 | 0.005 | 0.004 |
| PLA-1 | 0.011 | 0.009 | 0.005 | 0.004 |
| PGOX-1_NPS_E | <0.001 | <0.001 | | |
| LIP-1_NPS_E | <0.001 | <0.001 | | |
| PLA-1_NPS_E | <0.001 | <0.001 | | |

In addition, it is found for that six other cyclic peptides, which are c(VVWY), c(VLYW), c(VLFY), c(LLFY), c(VVFW), and c(VLFF) which are at detectable levels in supernatant of LIP-1, are below detection limit in supernatant of LIP-1_NPS_E (data not shown). Analysis of enzyme levels produced, indicates that roughly equal glucose oxidase, lipase and PLA2 enzyme activity levels can be measured in the supernatant for the respective enzyme producing and npsE disruption strains at day 4 (data not shown).

Example 5

Figure 6:
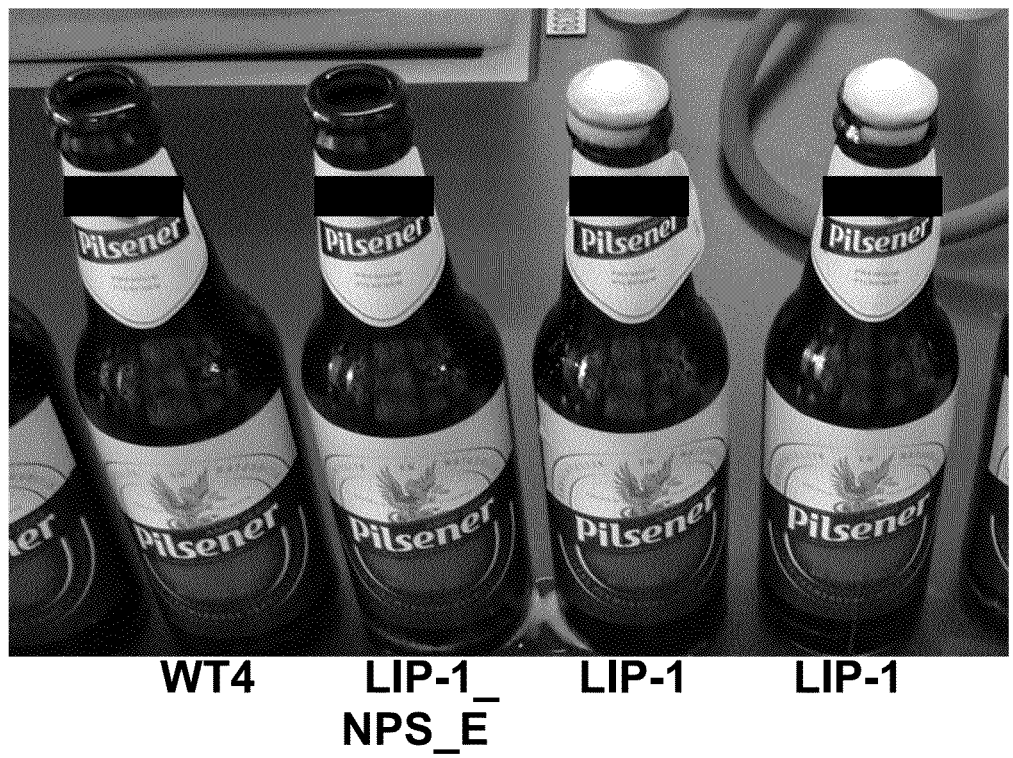
FIG. 6 depicts Gushing-inducing tests in beer with enzyme products produced by *Aspergillus niger* strains of the invention

Gushing-inducing Tests in Beer with Enzyme Products Produced by *Aspergillus niger* Strains of the Invention For cyclic tetrapeptides, a gushing-inducing activity can be measured in beer. The gushing activity was tested using freshly opened beer bottles at room temperature followed by gently adding 1 ml of culture supernatant to the beer in the bottle. As can be seen from beer foam formation in FIG. 6, the supernatant of the LIP-1 strain shows a strong gushing activity, whereas the supernatant of the LIP-1_NPS_E strain shows no gushing activity in beer.

Example 6

Disruption of the Non-ribosomal Peptide Synthase Gene Pc16g04690 in *Penicillium chrysogenum*

The strain used herein is Wisconsin 54-1255 (ATCC 28089).

As starting strain any industrial *Penicillium chrysogenum* strain can be used. Examples of such strains are: CBS 455.95 (Gouka, R. J. et al., 1991, J. Biotechnol. 20, 189-200); Panlabs P2 (Lein, J., 1986, in 'Overproduction of microbial metabolites', Vanek, Z. et al. (eds.), 105-140; Butterworths, Stoneham, Mass.); E1 and AS-P-78 (Fierro, F. et al., 1995, Proc. Natl. Acad. Sci. 92, 6200-6204); BW1890 and BW1901 (Newbert, R. W. et al., 1997, J. Ind. Microbiol. 19, 18-27).

To disrupt and therefore inactivate the non ribosomal peptide synthase gene Pc16g04690 (NCBI gene bank gene ID 8304562) (with a genomic sequence as depicted in SEQ ID NO: 31, the coding sequence depicted in SEQ ID NO: 32, the mRNA depicted in SEQ ID NO: 33 and the nrps protein depicted in SEQ ID NO: 34) in *Penicillium chrysogenum*, the double homologous recombination strategy was applied. For this, 5' and 3' sequences of gene Pc16g04690 were used as flankings to target the amdS selection marker to this locus. If double homologous crossover would occur the transformants would be able to use acetamide as the sole carbon source (due to the presence of the amdS gene). Double homologous crossover is a rare event in *Penicillium chrysogenum*, however, using construct with 3 kb flanks on either side of the amdS gene is sufficient to obtain positive (i.e. Pc16g04690 disrupted) clones. The oligonucleotides applied are listed in Table 2. Following PCR amplification the fragments were cloned in pCRXL via TOPO T/A cloning (Invitrogen). Subsequently the left flanking of 3 kb length was digested with Acc651 and NotI followed by ligation in pBluescript II SK+ (Invitrogen) pre-digested Acc651 and NotI. The obtained left-flanking plasmids were digested with NotI to facilitate cloning of the right 3 kb flanking, which was pre-digested with NotI and Eco521. The obtained 3 kb flanking-plasmid had a unique NotI site between the left and right flank, which was used to clone the amdS gene as selection marker. This was obtained by digesting pHELY-A1 (described in WO 04/106347) with NotI and isolating the 3.1 kb PgpdA-AnamdS expression cassette. The thus obtained deletion fragments were isolated following digestion with KpnI and transformed to the penicillin gene cluster single copy isolates. Transformants were selected on their ability to grow on acetamide selection plates and analyzed by PCR for deletion of the Pc16g04690 gene; the PCR primers are listed in Table 3. Selected transformants were analyzed by LC/MS for the production of small peptides, such as the cyclic tetrapeptides VVFY and VVFF described earlier herein.

TABLE 2

Primer sets used for construction double homologous crossover cassettes. Restriction sites are underlined.

| Flank | Size (kb) | Forward primer Sequence | Restriction site introduced | Reverse primer Sequence | Restriction site introduced |
|---|---|---|---|---|---|
| Left | 3 | SEQ ID NO: 39 | Acc65I | SEQ ID NO: 40 | NotI |
| Right | 3 | SEQ ID NO: 41 | NotI | SEQ ID NO: 42 | Eco52I, Acc65I |

TABLE 3

Primer sequences used to for colony PCR

| Gene | FWD primer | REV primer | Fragment size (bp) |
|---|---|---|---|
| NiaA | SEQ ID NO: 43 | SEQ ID NO: 44 | 251 |
| AmdS | SEQ ID NO: 45 | SEQ ID NO: 46 | 653 |
| Pc16g04690 | SEQ ID NO: 47 | SEQ ID NO: 48 | 1000 |

All putative deletion mutants were negative in the PCR for the gene Pc16g04690, encoding non-ribosomal peptide synthase, catalyzing putatively the formation of the tetrapeptides described above; thus indicating that inactivation was successful (see Table 4).

TABLE 4

Colony PCR on putative Pc16g04690 disruption mutants

| Strain | Fragment used for deletion with | niaA | amdS | Pc16g04690 |
|---|---|---|---|---|
| Wisconsin 54-1255 | – | + | – | + |
| Deletion mutant 1 | 3 kb flanks | + | + | – |
| Deletion mutant 2 | 3 kb flanks | + | + | – |

Example 7

Analysis of *Penicillium chrysogenum* Strains of the Invention with a Gene Encoding an NRPS Enzyme Disrupted All mutants obtained in example 6 were tested in shake flask to confirm the reduced production of cyclic tetrapeptides in the disrupted *Penicillium chrysogenum* strains. For this, the mutants were inoculated in liquid mineral medium. Samples were analyzed as described for the *Aspergillus niger* strains in this document. As visible in Table 5, the wild-type Wisconsin 54-1255 strain showed significant levels of tetrapeptides produced and secreted into the medium. In contrast, the deletion mutants analyzed produced no cyclic tetrapeptides or lowered amounts of tetrapeptides. This proves that disruption of the *P. chrysogenum* gene Pc16g04690 results in reduced production of the cyclic tetrapeptides c(VVFY) and c(VVFF), amongst others.

TABLE 5

Cyclic tetrapeptide measurements after shakeflask fermentation.

| Strain | Tetrapeptide VVFY (mg/ml in medium) | Tetrapeptide VVFF (mg/ml in medium) |
|---|---|---|
| Wisconsin 54-1255 | 0.002 | 0.004 |
| Deletion mutant 1 | <0.001 | <0.001 |
| Deletion mutant 2 | <0.001 | <0.001 |

SEQUENCE LISTING (48 sequences)

SEQ ID NO: 1 - DNA, 17780 bp, Aspergillus niger
ggtgtcactagccctgtcctcaacgccgggggaatttgctgcagagaccgacatattctgagaatatagaattgtgctgaaaatgtgcagtggtccctttccaaatgatcatatacgatggggtgatctggtgtttgtcgtctgtggagcggatttccggccggactcggacctgcagctcggtccacagatggaaattaattgacgcactatcaccaaccggaccggaatggcttcgccacatacaacatgagttcaacccgcggaacagctgaagtctcaatccacttcgctttgtgttaaattgttccgataatacgtgtaactgcgtacataagaaatccaggagacaccccaatctccccacgcatcctgcaccactgctaaggccagtctacacaacccctgaatacttcgctactgtccctgagagtgctccatcgtcaactgcaccgcaactgctgaagccacaaacgtggcattgctagcagcattgggaacgtccttcgccacggaggcatgatcccccgccacaaacacccccggcaccgtggtctccatcgtgacatccttttgcttataaatcccactttcatccagctccagtcccagctggctgctccaatcatttgtcacgactgtatccggcatatgcgtgagaaatcccatatctacatagctgttaggaatatcacttccgtctggctgtcccagccagactcgcaggatgtctcgcgaatcctcagcagccgacacaactcgttcaaatgaacaaatcgggcgagattcaatagtaaatcctcgcgcttccgcaccggcctgctgtagggcgaccgtagtctcttcattgccatgtgtgaataatgttacttcctcggcgaaacgacgaaccatctgcccgaggatcaggcccacagagggattggcgtgtagttgtgagctctctgctacaagtaggcctgcattcggtgcgccacgctcttcatacccatggcagaacaggcagtggaagatgagctggccccagttcccagcgtacccctcaatggcaggcatgatgtcgcgtattcccgtagcgagaacaagttttgagccctgatatgcagttccatcttcatcagtaatttcgaagcgtgttcctaccccgtcgtggggtagcttgcgcgcttgggtgattttcttgttgatgatggtattggtggtgtatcgatgcaagagggtgtcgtggatggcggagcggaaacgtgcaggttccacatgctaacggcaacgcaggagtagttagcatgttgcatgccggacaggtaagagacggaattaacttacatcaaatccgaggacattgtgcatatgggacgtctggcggttgcgatactcctgactgtcgaacagaagtaccgaatggagcttgcgggatagcgccagggccgtggcgaggcccgcgggaccgcctccgatgatgagcacgtcggctgtggtggccatgcttatttcccgtttgcagttcctcttctccttgatagctgcggaatggaataaattaagctaatcaacatcttgaagggtgcgaaaacaagaggggatcgtaaagtccgttaagtagggcttcagtccggtttgggatctcggaccgcggattaccgtcacgttacagttgttctccactattttccggcgtgattccgatgcaacttcgctttcagctctgcaccaacggaattcatattggctcgttttattagccagagtgtctagtcaactgcagctcagccgcagatccgattctatcctgtttgcttaccctggttggtattgcgttagtggcacggacgccgacagctggataaccggttatagtagtatcaagtgatgaataattatatatagtgcgaataagtacatgaactacattatgagagtgaccattgggaaattcattttcagcacccaagagcttcatccttttcttggtcgtattctgtgacgtcttcgactgcaacatgagtcgcttttcttgcatcttccctaccctaacggatgggtatgtcccaaatctagatcaaactcgtgccgcaggtcggcgaacatacacgatcgaccggagaggatggaccgccccaagcagtcagacagaatcgcacatcctagcagcctggggccttgttctatccagctacgtaggcaccgatgaagtggctttctacattgtgccaacgactggtccggacacaacagcattggctgaattgaaggtcgagggagacatgtctcgccggtccctcatcaacgctgccgagcagttgttgcacccaggacccgtgggtgccggccaggtgtctggggagtctgccaatacgataatcacctttgagaaggatattgagtcgttatttgttactcaggccgaggtacgcgcgtcgccaccccgtattacagtggcctacctgggcttgtggaaaataacgggcatctaggagtccttcctatcgttacatgttcatcatgatgggcaagggcaggtctatctttctcttacctaccacctatcgctcttgaccgacgcgcaggcagcaaatgtgggcactgcgatggcccaggcgctcgccgaggtgggggcagacgaccacaataggttaatcaagaacctcaatctcatgagcccgacacacctggaaagcatctggcagtttaatgccaatgttcccggtatgtgggaggagtgctttcatgatgtgattgagcgtcgcgccgcgaatcgcccacactccctggcggtcgatgcctgggatatgaagctcacctacgccgacctcgtaagggaggcacgtctgctcgccgcatacctgcagcaccgcggcgtgcgtccaggatccgtggtccccatttcattcgaacggtcgggagcagctctggttgccatgctggctgtgtccaaggccggcggagcctttgtcagtgtgccaccgactctccctgctggacgactcgacgccattctggaagtcatcgaagcaccgtttgtggtaacttggtcgaagtacgaaccattctgggccgaacgcctccctacgctccctatagacagctatcccaagccatctgcagatgcgacggtgaaaaccctcggaaagcccgaggaccttttctatgtaattttcactagcggttcgacaggccggccgaaaggctgcatgctgtcccactcgaactggctgaacggcgcgcttcgtaacgctcctagttggaagtatggtcccgagagccgtgtcctgcaaatgctgagccacaccttcgacatgagtctgctggagatctgcaccagtctgggatccggggcctgcgtgtgtgtgccacgcacagaggaaatcgaaaccagcgtctccgatgccatcaacaggtggcaggttaatcatgttatcatgacaccttcacttgcccgctccttgagacgcgacgacgtgcccgggctgaagacaatgtgccttggtggtgaagccttccccagggagattgtcaccatgtggtccgagcggattaatctgtggcaattctacggccccagcgagtgctcaattaactcgtcatcgcggccaatcacacggcccgatgcggatccgttgaatatcggtcctcccaactcggctgcttgctgggtagtagatactcaagattacaataaactggttcccgttggtgctattggagagctacttgtttctggacctattgtcggcatgggatatctcaaaaatcccattaagacagccgaggctttccttgatgaagtcgggttcgtggcgaaggatgatccccagtttggtggattccggttttaccgaacaggtgatctcgtgcggtggaactcggacggtactatcactttctgcggccgtgctgatacgcaagtcaagcttaatggccagcgacttgaactggccgaggtggaatatcagctggggctggaagctggcgttcagtatgccattgcaatggcacctcaatctggtcggtgcaagaacaatctgattgctgttctcaccgtcaagtgcggcggcgctagcaaccagggtaatgctgacgacgaaatcccactgctggaccgccacgatccgattgtccagcagaccgttaagaagctgcgttcgcaacttcagcacgctctgccgcggtatatggtgcccaccatctgggcgttcgttgggcgcatgcccatgtcaccgtctggcaagattgatcgcgtacaactgaggaactgggtgcaagagatgagccaggagacgttcgacgcaatcaccggtcgaagtttcgaggcggaagatcatgttctcggcctcagccagctagagcaggagatccagctcgcctgggccgaagctctgggtctctccgccgctgaggtgggcttgcagcagccatttgtcgcgctaggcggggattccatcaaggccctcgatgccgtagctagatgtcgggctcgtcagatcaagattagcatggtgcatatcttgtcttgcgaaggcgtccgagaggcttcctcgctggcagaagtgcaggagacccctgctcatcaggtggccgagatcgcggtggattactcggatctgtggacccgtctgtccactgaatatgacattagcaagctgggcgtcacgcaggttgaagaggtggaggatgtcttcccctgcacaaccatgcaagagggcatgttcctcggccagatccgtcggcctggagcctaccacatgcgttttttccaccgcgttcagctgaagggtggttccctaccgaccgttgaacgcatccagcaggcctgggcctcccttgtcgagagacatccttcattacgcacagtcttcgtggatgatctgtcctcagaggccatttatcattcggtcgtgctgcggtccgtgccgatggagcttacaatgcgtgaggtgccgcgagacctcaaccccgaatcggccctcgctatgttcacggaggagctcgtgccctttcgtcctaatgccccattacatcgcatgcttctgctgacctgccgcggacgcgtcccatatcttatgctggaaatttctcacgtcatcatggacggctatgcgctgtcggttttccgacgcgagttcatccgcgcctgctcctccactgcctccctgccgcgaggcccagactaccgcatgtttgccaactaccatcgcacacgacaaaccgacgagagtgcaaagtattggacaaattacctagccgactgtgtgccatgccacatccctacggatccgttgagtgtgccgacggatgcctcccctgaatggcctcggacgctgcagcgccgcgactttggcttcgacaacagcgtagcgttcctgcagcgatgcaaagagcgccaggttacactcgcttgtgcgatccgcgctgcctgggcgctggtgctacgcgcctacacccaatcacgggatgtttgcttcggctacgtctcctccgggcgcaacgtgccggtgcccgaggtcgagactatttttggtttgtgtctcagtatgcaggtctgtcgcgcaaagctaagcgaggcttccacaatcgctagcctcgctaggaagatccaggaggattatgttgctagcttgccattccagcactacccattggcagaggcacaacgcgggctgaagcaaacacatggacaggggctgttcaacacggcgatctccatggaatgggtgcctccgacagcggaggatgaggatgccttgctggatttggaggagattcgtgaacaggatgacccgactgaggtgagttcaaaatccaaccgtcaagacttaccttactgatggcgtgtgacgctgcatagtacgacatcgccatcagtgtggatatccacgaaggccacatcaaactgggcttcctctattggcccaacttgagcgacttccagattacccatctcgccgaggccctccagggtgccatgaactgctttgcctttcagccagacgtggccctgaacactctcactcttctgcaggccagtgatttgtgctccaccctaactaacggacctaccctgctgcctctagaagccgtccgcggcaacgtgatatcgatgatagaccgctgggtgacccgccagccggagagccctgccatcgacggctgggatggatccctgacctacaagcaactgcacgagcaatcctcctgggtggctcgcaatctgcttcatcaaggggtaaaattgggagaccgcatcctggtgtgtgcagaccggtcaagtcgcactgtggtaacaattctaggcgtcgtgcgggcaggatgcgtgctggtgctctcgaacccgacggacccggaaaagcgcctgcagtggctggcacacaagtgcaatgctaccctggtcgttgctgatcctgcatacgaagagcggtttgcgacttccggtgctcgtgtattttcaacaacctccgtttgtgcccccgcagcctgggactacgagttctcagctctggacgatcaggaccttgtcagcatcctctttacctccggcagcaccggcaccccgaaaggcatattgatggaccatggggcactcgcgaccagtgttctcctgggccatggccgcacgttacgcttctcacgccacacccgcatgctgcattttgcctccctaacttttgacgccgctctggcggagatctttaccaccttggcacatggtgggtgtatctgcgtgccgtgtgaggaagaccgtctctctgacgtgtcgggttgtatctcccgctttgcggtcaacaccgctatgctgacaccctccgtcgggcggctgctggatcccgaggctctgccaacgctgaaggctctggccatgatcggcgaaccgatgtcccggttggatgttgagcggttcgccccggtacttgacctctacaatggtgcaggacctacggaaacatccataatggtaacaattgccgggccgatgaaaccgactgatgagccagtgaatctgggttatgccgtggccggcgttaggctgtgggtgactgaggctgagaaccctaatcgcctggctccgttgggagcagtcggagagttgatcgtcgagggccgcttggtcactcgcggatacctggatgatccagcacgcactagggagtctttccttcccaatttaccatggcttccgtctcagcatgccttgtaccgaacaggcgatttggtgcgctatgcggaagatggcagcttgcggtatatgggacggaaggacacgcaggtcaagttgcgtggacaacgcattgagctacaagaggtcgagtatcatctgcgaaagagcttacagcaggcacaggttgtggtggagatggtcattccagaggggaaaattcgtgctcaggcaagcttagtggcttttgtcagtggtttgacagcggcagatgttgagtcgtcttcggcgcgtaactttgaccagtcgatgcccatgtcacaaatcgccttgcccggcagtacgatccaagcgcttgaggaagccctgcctcgctatatgatcccgtcggtgtatttcgccctggacacgatcccgctctcagtcaacggcaaggcagatcggcgaagactgcgtgagataggtgccgcgctgctggtatccagtaccgcccataagaacactgttgatggaaagagcgagcctgtcaaatggacagcatcttcgaaattggagctgacactgttggaattgtggactacgacacttggacttgaggctgaaacaatctatggcgatgatagcttctttgaattaggcggcgactctgtttctgccatgaagctggtggccacggctcgggatagattcaagctgtcgttgagtgttcctcaaatgttcagacaccccactattcatcagcttgccgccatacttggggaggccactgggcagccagaaagctcagcttcgtccacgactgaggaaggattcacattcagcacgccagatgactcctccaccaatgacggggtcgatgacgattttctacggctggccaccgctcagcttgcccaactggcgcaagagaagggtaagaaggtggatattgctgctcttctaaagcagctgcaaggcggttcctcttcctgtaagaccccatccgtgtcttcctcctcatcatcgtcgtcgtcgaggaagaagaagtcagccaaagtggtgtccccagtcgaagcacctgctcctgtcccagtgccattttccttgttggatggcggcgctgatgttgtagagaagattcgtgcacaggccgtggagcagtgcaagatcctacccggggatattgaagatatttatcccgccaccgctctacaggaggggatgatggcgctgatggccaggacacccggggtttatacaacaactttaacatgtgagctccctgagcgggttaatcttgcacggctgcactccgcatgggataaagctgccgaggcgcatccaattttgcggacgcggattatcctcaccgaaaacaacacggcagtgcaggttgtgcagcgtgcgaaagagcttccatgggatgcctattcccttcaggatggcgaccctctgccagacctaacgtcgaacatgacccttggttctacccttctgcgcctagctgagatacaccggcaaaaccagcctcggatgctgctggtggccattcatcacgctctctacgacggatggtcaatgccactgctcaaacaggcagttgaggatgtctatcatggacaggagttgtggccacagcccttcaccccattcattaattacctaaatgagggaaagccggcggcacaaggctactggaccgcccacctggacggcttcgcaggaagcgtcttccctaatttgcctagcataaaccaccatatccagccgacggagcgtcgaacccgctcactggccgtgccgacagcgccccccggatcgcagtatactatggcgacaaaaatccaagcagcgtgggctgtcacggtttcgcgatatgcagaggctgaggacattgtctttggtaccgttagtaccggtcgttcggcacctgtgccgtcgattgatcgcatggtcggtcccaccatcacgactgtgcctgttcgcatctcgctcggcaaccaggcagagcgtctcacctcactgctgcagagggtccaagaggatggctggaacaggatggatcatgaacacctgggcctccagcacatccgccgtctcggtgaatctgctgctgctgcttgtaacctccagacgctgttagtaattcagcctcgtgaagagcctcgtgccaaatccatttccaccttactttcaggattgcaagacgtggctgaactcaagggcgtggatacgtatccgctaatgttggtgtgcgagcctgatggtgtcagtctgcatttgactgccgtgtttgatccagccgtcctggacgcagtcatgctggaccggatgcttgctcattgggagctcgttctaaatcaaatatggagtgagccggacatggcagtgatggggcttgatggcgtatcatacagggataagcagacattggtaagatggaatgctggagaaaagattgctgatggatgtgcccatgacgcggtgtatgagtggagtgtccgcacccctcatgcacccgctgtcttcgcttgggatggtaaatggacctacgaggaactggagaagtgctcctctctcatagccagtcaggtcctagtccatggtgtctcctccggagactttgttgctctttaccacgagaagtctcgatgggcggcggccgcaattctcgcggtgttcaaagccggcggcatcctggttaccttggacccggcccatcccaaagacagaatcaaggatatcctggatcaagcacggccgcgactcgtactgacctctcagtctctcctcgatgaggctagagaacttgagaccccggtcatggttgtacagttcgcagcatcccaaccaatgcccggagaatgcttccctctacccacagtaagccccacccaggctgcatatgctccgtttacctctggatctacaggtcgaccaaaagggattccattagagcatcggggactggctgcttcaactgcttcagtagctcgtgcctgcctactgcgcccagcatcccgagtccttcattttgccagcttcgcctttgatgccagtatgatggagcacctgatagcctggcacgccggcagctgtctctgtatcccggttgaaactgtcaggcagacggatctggccaggtgcatacgagacttcgaagttacttgggcttttctcacaccttcatgcctacggctaatctcccccgatgatgttcagtcccttgaagccctgggtctaggtggtgagtctatgacgcccgaggatattttcatctggggtccgcgactccgccagattgtccagctatacggcccggcggagtgttccattgtggccgcgttgacagaagttaccaagccatcggagaaccgattgatagggagacccaatgcctgtcgatgctgggtagttgacccacacagcccagatcgcctagcgcccctaggtgctgtcggagagctggtaattgaggggatcactgtcggtcggggttatattgacgatcccgagcgaaccacccaagcatttataccaccccctacatggattcaaacactgtatccgaatgagcaacagccaagtcgcctctatcggaccggtgatctcgtacggtatgctggtacggacgggaagctgaccttcatcgggcgaagggacggccaactcaagcttcacggacaacgtatagagttggcggacgtcgaagctcacctccgtcctctaatacccggcacgcagaaggttgttgtagagatggttcacagtgtgggcaaccaccacccccttttagctgcctttgtggaagaaatattgacatcacaagatcaagtggagcaagtggttaatctattgcacccaagtcaaacccaatgtgccctgaatgtcaaggccatcgatagtgcactgtcccaaacggttccccaatacatgattcctagcatgtatctacatatctcccgcctgcccctaagcgcatctggaaagctcaaccgtcgccacctgcgtaggttggtcgcagagtttccacgtcagagactcagtgaatacgctgctggatcaggcctcgcagtcccgaaccggccggcaacagctcaggagcgtgaaatgcaggctatctgggcgcgagtattgtcagttgacccggacacaatcggagtcaacgaagactttttccgcatcggcggcgactccatttccgggatgcaggttgccacgagatgcaatgcggcaggcatgcatatcaccagtgcggatctcttccaacaccgtaccatcgagcaactgatgcgccatcttagtgctaatggaaagactggctccgcgtcaatctcactacctccagagccggtggacgagtgggttcctcttgcccccatccagcaactcttcttcgaaatcgccccacagggtccagatcacttcaaccagagcctgctcctgcgcactagccgccgggtcagtgcagaaaaactcgccggaggcctagatattctcgtgggacgacattctatgctacgcgcgagattttgtcgcgatgattccggccaatggtcccagcaggtaaggtcgcgcggcccgtaccctgctagtgcattttaccggttgaccacacacaaccacatcgctcctgagttgctgtcgtcacttcttgctgcgtctcagatggccttgtctattcaagaggggccgctcttagccgttgatctggtgaatttgacggacgatactcagctcgtctacttggtggcccatcatctcattatcgacctggtctcgtggcgcatcttgcacgcggaattggaggaatatctgcagacgggctccttcgcgtccaccacaggctctgtccccttcttgacctggagtcgagcacaggccgaatacagcgctaatcaccttactcccacacttcctctacctggcttccaggaagcaaacgatggcttcgatgcctcgaggtactgggggatttcttgcgagtcgaacacattcgggcaaacctccacttccacgttcaccttggaccagactgtgaccgaccaactcttcggccccgctaacaacgtgcttgatactcgaccagctgaaattttgcaagctgccctctggtactctttcactcaatctctcaccgaccgtccgggtcccagcatctacgttgaaggtcacgggcgagaaccgtggacgggttccattgacctttcgggaacggtcggttggtttacaaccatgtctccgctagtgtccgctccgtgggatagcctatcacagacatcgatgcgggacttcctcgatgcgctcagctatatcaaggaccagcgccgacgcattccggctaacggatgggcgtacttcacctcacgatatttgaacgacgaaggcaaggtcgcgtatgggcgcatgaagccggtcgtggaaattctgtttaactatatgggccagtaccaggagatgaaccgtgaggacgccatactacagctggctggcgatggcatccagtccggtaccggtgctgcagacgttgcggacaacgtaccacgcttttcgttgatcgacgttagcgcgttcatctcgaacggatgtctaaccttccagtttatactccctaaatctttgcagcaggactctcgactgcaagggtgttttcaggaatatgaacgcactctcgtcgccgctgctaattcactgtcaactgagggcccccgcaaaacattggccgactttccccttatgcctgcactcacatacgatcagctaagccagtgccttgatcatacgctgccttcgatgggtttgtgtgcccgtgacgttgtggacatctatccctgctcccctgtgcaacagggaatgttgttggcccagctgcgcgatcgacaggcatatcagcaacgattcagattccaggttaagtctcgcgggtcaacagaccgactcacattagaaaagctgaaggacgcttggactgaagtgatcaaccggcatgacatcctccgtactctccttctaccagtttcggattacagccacttggaccaagtagtcatggcccctggcagtcttcaacatctggttcggattaatgcgatggacaccaatcccacacagggcctaccacactcgattaacatcaccagcgactcaaccggcactgtaatttgcgagtggaatgtcagtcacgccttggtcgatgccatgtcgattgcggtcattcaacaggaggtcaatgaggcgctggaagggtcgctgggtcagcatcaaaaaacaccgcgatacgcagattacatccaatggctttctctgcaagacaacaccgagacacaggcgtattggaaaaagtacctcgagggagtggagccatgtctctttccaaaattggcttcttcgactgacaaagtcaacccggaaggtaccatttctgccattcgtgccacctggacccgcgattcgcggttggacaagctatgccatacgcacggtatcacattgacaaacctattccacattgtctggtcccttcttctcagcgcctatctaggcactgataaggtttgcttcggctatacgacccttggtcgagatgtgcctgtcgacggggtagagaagatggtcggccctctagtcaatgttattgccacaaccatccaacttcaagaggacgattcgatcttggatgcacttctcactcatcaaacccatctctcaaatagtctccaacaccagcattatgcgttggcagacgtgtatgcctctttaggtctggtcggttctcagctgttcaacactatcgtgtctttgcaggatatatctcacttcgatgccaacgacgagcggccgaccagggtcgaaatgctccctgcaaatgacgtctcagaggtatgtcccagagcgatagtctacgaaactctccatctttaatgacgctaacctttactacagtatgatgtggctctcaatatcggtgtcgatcaatcttccattcaagtggtctgcagctaccgaacactatcgctgtctgtggagcaggccgacgcgctactgcgaactacctcccatgtactggatgaaatcctgagggatcccaagcaaccgcttcgggaccttgaggtgattagcccccagtgtaaagagcaactcgtaaagtggaacgctgccatgcctgccccgaccgatgaatacatccatgagaagattcaggaccaatgccgtctccactcttcccgagaagccgcttgcgcctgggacggcatatttacgttcgctgaagttgacgacctatcgtcacgtctggcagcacggcttattaggatgggggttacctccggtcacatcataccaatctactcacccaaatcccgatggacggtcatcgccattctaggagtcctaaaaactggggctgccttcacacttctagaaacatcgcatccgacggctcgactgcgcgttatatgcaatgagatcaaggctgatataataatcgcgccagcatcgcatgccgtcccagcggcaactttggctcctatcctagtcgtgctcgacagcatcacgtcgatgagcccccaagaatcagatctcttaccagctgtgggtatgccaccggctgcagaagctctcgcctatctcatcttcacttcaggctccacaggaaaccccaagggggttatggtcactcatcagaatttgtgcagtaatgcgtctataatgacaacatctgtcaatatgacatccgacagcagggtgctacattttgcatcccatgcattcgatgcgtgtctttgggaaatatttggtgccctatttgccggtgcttgtctgatcatcccgtccgagtcagagaccaaggaagatctggctggttgtatcgagcgcatggtcgtcacttgggcatttctgaccccttccgtcgcaaggatcttaaagccagaggcccttcccagtctccgtaatttagtcctgggaggcgagccgatagcggcctcggatttagatatgtggcggggtcacgtacaggttgtgtgtgcctatggaccaaccgaaaccgccatcctcgccagtacgacctcaccctctacctttcccagcgatggcaaggatatcggcgtgccaactggtagctccctttggattgttgacaagcaaaattacaacaagctggcacctcatggagccacaggcgagctgctgattgagggccccaatgtgagccaaggatatcttggggatccagagaaaaccaatgaagccttcccagtcgctccacgctggctgtcacagctccgaaagtcgcctaccagggtctaccgaactggtgacttggttcgcttcaacacatctacgggcaccattcacttcgttggacgcaaggataaccagatcaagttccacggacagcgcatcgagctcggtgacatcgaacatcatgctcagcaggccttttcgaatgccagcatggtcatcgtcgatttgattacccctgaacagcctcaacaaccatatattgttgctttcgtacatcaagcagatacaaggactggaacggccgacccaattgacaccatcttgcttcctccctccgaatccttccgagcagacgcaataggagcgcagaaccacatgcacaaacgactcccgcactacatggtcccaacagctttcctccctttgcatcggcttcctctatcaggcactggcaaagccgatcgcaagcgcctccgacaatgtgcactctctctgtccagccttgagctcaatgcatatcgcgccacagcctccgcgaagcgtatgcctttcaccgcagcggagtgcaaaatgcaggaattggttgcaactgttctgggaagggacatgtccgagattggcatggatgacagctttttctatctgggaggtgactccatacaagcaatgcgcctggtttctgagggtcgtcaacaaggccttaccctctcccttcaagcaatctttgacgctccccgtctgggtgaccttgcttatcggacagccaacctggtcagagtgagcgagccagccccgcccacattgccagccacctcaagtgatgattgcgaccataaagagacaatagttgcagctctgcccatcaagaagactgacgtggccgaagtccttcccacaacctcttttcagcgcacctggctagactcacagctgaagagctacattgtcgtcgacatcccaggcccgatcgatcttgcacgtctccgtacggccatacagcgggtcgtgaaggcgcaccctattctccgagcgtccttcgtgccttatgaaaccacaaccatgcaagttatcctccgcacagcagtggtcatcacaaaggccgacctgtccaccactaccgtggaaggcatttgccgcaaggatgcaaatgccccaatggcccctggaacgccgtatctgcgcgtcatcctagcaactcaaggagaagtagatcgtaaactgatcatgcgactttctcacgcccaatacgatggtatctcactctccctactcatgaatgatctgagtcacgcatacgcaagcgagtctcgtccattaccttcatcccacttgcccgcgttcaacgactatattacctatcagcaaactcagggagccgaccccacagcgaccacattctggcatcgtctcctcaaagacgtgccaattacctaccttgatctccaaccagccgagaccccaaccagcaatggatccctcattacacgtacccgcgacattaatattgctgccttcccatcactccctaacggtatcaccacagccacagctgtcaaggcagcctggtcgctggtcctagcccagaagactggttcccttgccgttatatttggccaggttgtccatggtcggggaattgcgcttaccggggttgagggtattgtcggtccttgtgctaatattacgcccgtcgttgcacgcctgggtcctcaaactacaagaatggagttaatgcaaacgttgcaagaccaacaccgctctgctatgccatatgagacggtaagtctggatgacgcgctggcttatactaaggactcgcaggccgggcgtaaagagttgcaaacaatcgtgcagcatcagaataatgtgatggctgacgatatggaactgtcgcttggagaggcaaggtgtcgggtcgatctgagggcagtggatcatgtgccacaagaggtatgggtatattcgtctatcgatgggggaagaccgggtatgttggaggtgaagatcatgtcgtcgacgttggtgttgagtgaggaggttgcggaagagttgatggatttgcttgtagagatgatgaagaggttgtttagcgatcctgagggtgtgtgtgtttgactgagctttgtcatggagtgacggtagagcttggactgttgtatatagtttcttgaattgacatgaagagaggattacctcgacttccaccttcggcaacgttgaagatttacttcccaccattccactgaatatatactacacacccttctaaacacgacctaacatcatcaccaactctccacggaacccacacaacacacgaaattaaaccctcctcacaagaaactgcatcttaaacgtcgtctccccattatgcgccaccttcgtaatccccttccactcctcgccc

SEQ ID NO: 2 - DNA, 15165 bp, Aspergillus niger
atgagtcgcttttcttgcatcttccctaccctaacggatgggtatgtcccaaatctagatcaaactcgtgccgcaggtcggcgaacatacacgatcgaccggagaggatggaccgccccaagcagtcagacagaatcgcacatcctagcagcctggggccttgttctatccagctacgtaggcaccgatgaagtggctttctacattgtgccaacgactggtccggacacaacagcattggctgaattgaaggtcgagggagacatgtctcgccggtccctcatcaacgctgccgagcagttgttgcacccaggacccgtgggtgccggccaggtgtctggggagtctgccaatacgataatcacctttgagaaggatattgagtcgttatttgttactcaggccgaggcagcaaatgtgggcactgcgatggcccaggcgctcgccgaggtgggggcagacgaccacaataggttaatcaagaacctcaatctcatgagcccgacacacctggaaagcatctggcagtttaatgccaatgttcccggtatgtgggaggagtgctttcatgatgtgattgagcgtcgcgccgcgaatcgcccacactccctggcggtcgatgcctgggatatgaagctcacctacgccgacctcgtaagggaggcacgtctgctcgccgcatacctgcagcaccgcggcgtgcgtccaggatccgtggtccccatttcattcgaacggtcgggagcagctctggttgccatgctggctgtgtccaaggccggcggagcctttgtcagtgtgccaccgactctccctgctggacgactcgacgccattctggaagtcatcgaagcaccgtttgtggtaacttggtcgaagtacgaaccattctgggccgaacgcctccctacgctccctatagacagctatcccaagccatctgcagatgcgacggtgaaaaccctcggaaagcccgaggaccttttctatgtaattttcactagcggttcgacaggccggccgaaaggctgcatgctgtcccactcgaactggctgaacggcgcgcttcgtaacgctcctagttggaagtatggtcccgagagccgtgtcctgcaaatgctgagccacaccttcgacatgagtctgctggagatctgcaccagtctgggatccggggcctgcgtgtgtgtgccacgcacagaggaaatcgaaaccagcgtctccgatgccatcaacaggtggcaggttaatcatgttatcatgacaccttcacttgcccgctccttgagacgcgacgacgtgcccgggctgaagacaatgtgccttggtggtgaagccttccccagggagattgtcaccatgtggtccgagcggattaatctgtggcaattctacggccccagcgagtgctcaattaactcgtcatcgcggccaatcacacggcccgatgcggatccgttgaatatcggtcctcccaactcggctgcttgctgggtagtagatactcaagattacaataaactggttcccgttggtgctattggagagctacttgtttctggacctattgtcggcatgggatatctcaaaaatcccattaagacagccgaggctttccttgatgaagtcgggttcgtggcgaaggatgatccccagtttggtggattccggttttaccgaacaggtgatctcgtgcggtggaactcggacggtactatcactttctgcggccgtgctgatacgcaagtcaagcttaatggccagcgacttgaactggccgaggtggaatatcagctggggctggaagctggcgttcagtatgccattgcaatggcacctcaatctggtcggtgcaagaacaatctgattgctgttctcaccgtcaagtgcggcggcgctagcaaccagggtaatgctgacgacgaaatcccactgctggaccgccacgatccgattgtccagcagaccgttaagaagctgcgttcgcaacttcagcacgctctgccgcggtatatggtgcccaccatctgggcgttcgttgggcgcatgcccatgtcaccgtctggcaagattgatcgcgtacaactgaggaactgggtgcaagagatgagccaggagacgttcgacgcaatcaccggtcgaagtttcgaggcggaagatcatgttctcggcctcagccagctagagcaggagatccagctcgcctgggccgaagctctgggtctctccgccgctgaggtgggcttgcagcagccatttgtcgcgctaggcggggattccatcaaggccctcgatgccgtagctagatgtcgggctcgtcagatcaagattagcatggtgcatatcttgtcttgcgaaggcgtccgagaggcttcctcgctggcagaagtgcaggagacccctgctcatcaggtggccgagatcgcggtggattactcggatctgtggacccgtctgtccactgaatatgacattagcaagctgggcgtcacgcaggttgaagaggtggaggatgtcttcccctgcacaaccatgcaagagggcatgttcctcggccagatccgtcggcctggagcctaccacatgcgttttttccaccgcgttcagctgaagggtggttccctaccgaccgttgaacgcatccagcaggcctgggcctcccttgtcgagagacatccttcattacgcacagtcttcgtggatgatctgtcctcagaggccatttatcattcggtcgtgctgcggtccgtgccgatggagcttacaatgcgtgaggtgccgcgagacctcaaccccgaatcggccctcgctatgttcacggaggagctcgtgccctttcgtcctaatgccccattacatcgcatgcttctgctgacctgccgcggacgcgtcccatatcttatgctggaaatttctcacgtcatcatggacggctatgcgctgtcggttttccgacgcgagttcatccgcgcctgctcctccactgcctccctgccgcgaggcccagactaccgcatgtttgccaactaccatcgcacacgacaaaccgacgagagtgcaaagtattggacaaattacctagccgactgtgtgccatgccacatccctacggatccgttgagtgtgccgacggatgcctcccctgaatggcctcggacgctgcagcgccgcgactttggcttcgacaacagcgtagcgttcctgcagcgatgcaaagagcgccaggttacactcgcttgtgcgatccgcgctgcctgggcgctggtgctacgcgcctacacccaatcacgggatgtttgcttcggctacgtctcctccgggcgcaacgtgccggtgcccgaggtcgagactatttttggtttgtgtctcagtatgcaggtctgtcgcgcaaagctaagcgaggcttccacaatcgctagcctcgctaggaagatccaggaggattatgttgctagcttgccattccagcactacccattggcagaggcacaacgcgggctgaagcaaacacatggacaggggctgttcaacacggcgatctccatggaatgggtgcctccgacagcggaggatgaggatgccttgctggatttggaggagattcgtgaacaggatgacccgactgagtacgacatcgccatcagtgtggatatccacgaaggccacatcaaactgggcttcctctattggcccaacttgagcgacttccagattacccatctcgccgaggccctccagggtgccatgaactgctttgcctttcagccagacgtggccctgaacactctcactcttctgcaggccagtgatttgtgctccaccctaactaacggacctaccctgctgcctctagaagccgtccgcggcaacgtgatatcgatgatagaccgctgggtgacccgccagccggagagccctgccatcgacggctgggatggatccctgacctacaagcaactgcacgagcaatcctcctgggtggctcgcaatctgcttcatcaaggggtaaaattgggagaccgcatcctggtgtgtgcagaccggtcaagtcgcactgtggtaacaattctaggcgtcgtgcgggcaggatgcgtgctggtgctctcgaacccgacggacccggaaaagcgcctgcagtggctggcacacaagtgcaatgctaccctggtcgttgctgatcctgcatacgaagagcggtttgcgacttccggtgctcgtgtattttcaacaacctccgtttgtgcccccgcagcctgggactacgagttctcagctctggacgatcaggaccttgtcagcatcctctttacctccggcagcaccggcaccccgaaaggcatattgatggaccatggggcactcgcgaccagtgttctcctgggccatggccgcacgttacgcttctcacgccacacccgcatgctgcattttgcctccctaacttttgacgccgctctggcggagatctttaccaccttggcacatggtgggtgtatctgcgtgccgtgtgaggaagaccgtctctctgacgtgtcgggttgtatctcccgctttgcggtcaacaccgctatgctgacaccctccgtcgggcggctgctggatcccgaggctctgccaacgctgaaggctctggccatgatcggcgaaccgatgtcccggttggatgttgagcggttcgccccggtacttgacctctacaatggtgcaggacctacggaaacatccataatggtaacaattgccgggccgatgaaaccgactgatgagccagtgaatctgggttatgccgtggccggcgttaggctgtgggtgactgaggctgagaaccctaatcgcctggctccgttgggagcagtcggagagttgatcgtcgagggccgcttggtcactcgcggatacctggatgatccagcacgcactagggagtctttccttcccaatttaccatggcttccgtctcagcatgccttgtaccgaacaggcgatttggtgcgctatgcggaagatggcagcttgcggtatatgggacggaaggacacgcaggtcaagttgcgtggacaacgcattgagctacaagaggtcgagtatcatctgcgaaagagcttacagcaggcacaggttgtggtggagatggtcattccagaggggaaaattcgtgctcaggcaagcttagtggcttttgtcagtggtttgacagcggcagatgttgagtcgtcttcggcgcgtaactttgaccagtcgatgcccatgtcacaaatcgccttgcccggcagtacgatccaagcgcttgaggaagccctgcctcgctatatgatcccgtcggtgtatttcgccctggacacgatcccgctctcagtcaacggcaaggcagatcggcgaagactgcgtgagataggtgccgcgctgctggtatccagtaccgcccataagaacactgttgatggaaagagcgagcctgtcaaatggacagcatcttcgaaattggagctgacactgttggaattgtggactacgacacttggacttgaggctgaaacaatctatggcgatgatagcttctttgaattaggcggcgactctgtttctgccatgaagctggtggccacggctcgggatagattcaagctgtcgttgagtgttcctcaaatgttcagacaccccactattcatcagcttgccgccatacttggggaggccactgggcagccagaaagctcagcttcgtccacgactgaggaaggattcacattcagcacgccagatgactcctccaccaatgacggggtcgatgacgattttctacggctggccaccgctcagcttgcccaactggcgcaagagaagggtaagaaggtggatattgctgctcttctaaagcagctgcaaggcggttcctcttcctgtaagaccccatccgtgtcttcctcctcatcatcgtcgtcgtcgaggaagaagaagtcagccaaagtggtgtccccagtcgaagcacctgctcctgtcccagtgccattttccttgttggatggcggcgctgatgttgtagagaagattcgtgcacaggccgtggagcagtgcaagatcctacccggggatattgaagatatttatcccgccaccgctctacaggaggggatgatggcgctgatggccaggacacccggggtttatacaacaactttaacatgtgagctccctgagcgggttaatcttgcacggctgcactccgcatgggataaagctgccgaggcgcatccaattttgcggacgcggattatcctcaccgaaaacaacacggcagtgcaggttgtgcagcgtgcgaaagagcttccatgggatgcctattcccttcaggatggcgaccctctgccagacctaacgtcgaacatgacccttggttctacccttctgcgcctagctgagatacaccggcaaaaccagcctcggatgctgctggtggccattcatcacgctctctacgacggatggtcaatgccactgctcaaacaggcagttgaggatgtctatcatggacaggagttgtggccacagcccttcaccccattcattaattacctaaatgagggaaagccggcggcacaaggctactggaccgcccacctggacggcttcgcaggaagcgtcttccctaatttgcctagcataaaccaccatatccagccgacggagcgtcgaacccgctcactggccgtgccgacagcgccccccggatcgcagtatactatggcgacaaaaatccaagcagcgtgggctgtcacggtttcgcgatatgcagaggctgaggacattgtctttggtaccgttagtaccggtcgttcggcacctgtgccgtcgattgatcgcatggtcggtcccaccatcacgactgtgcctgttcgcatctcgctcggcaaccaggcagagcgtctcacctcactgctgcagagggtccaagaggatggctggaacaggatggatcatgaacacctgggcctccagcacatccgccgtctcggtgaatctgctgctgctgcttgtaacctccagacgctgttagtaattcagcctcgtgaagagcctcgtgccaaatccatttccaccttactttcaggattgcaagacgtggctgaactcaagggcgtggatacgtatccgctaatgttggtgtgcgagcctgatggtgtcagtctgcatttgactgccgtgtttgatccagccgtcctggacgcagtcatgctggaccggatgcttgctcattgggagctcgttctaaatcaaatatggagtgagccggacatggcagtgatggggcttgatggcgtatcatacagggataagcagacattggtaagatggaatgctggagaaaagattgctgatggatgtgcccatgacgcggtgtatgagtggagtgtccgcacccctcatgcacccgctgtcttcgcttgggatggtaaatggacctacgaggaactggagaagtgctcctctctcatagccagtcaggtcctagtccatggtgtctcctccggagactttgttgctctttaccacgagaagtctcgatgggcggcggccgcaattctcgcggtgttcaaagccggcggcatcctggttaccttggacccggcccatcccaaagacagaatcaaggatatcctggatcaagcacggccgcgactcgtactgacctctcagtctctcctcgatgaggctagagaacttgagaccccggtcatggttgtacagttcgcagcatcccaaccaatgcccggagaatgcttccctctacccacagtaagccccacccaggctgcatatgctccgtttacctctggatctacaggtcgaccaaaagggattccattagagcatcggggactggctgcttcaactgcttcagtagctcgtgcctgcctactgcgcccagcatcccgagtccttcattttgccagcttcgcctttgatgccagtatgatggagcacctgatagcctggcacgccggcagctgtctctgtatcccggttgaaactgtcaggcagacggatctggccaggtgcatacgagacttcgaagttacttgggcttttctcacaccttcatgcctacggctaatctcccccgatgatgttcagtcccttgaagccctgggtctaggtggtgagtctatgacgcccgaggatattttcatctggggtccgcgactccgccagattgtccagctatacggcccggcggagtgttccattgtggccgcgttgacagaagttaccaagccatcggagaaccgattgatagggagacccaatgcctgtcgatgctgggtagttgacccacacagcccagatcgcctagcgcccctaggtgctgtcggagagctggtaattgaggggatcactgtcggtcggggttatattgacgatcccgagcgaaccacccaagcatttataccaccccctacatggattcaaacactgtatccgaatgagcaacagccaagtcgcctctatcggaccggtgatctcgtacggtatgctggtacggacgggaagctgaccttcatcgggcgaagggacggccaactcaagcttcacggacaacgtatagagttggcggacgtcgaagctcacctccgtcctctaatacccggcacgcagaaggttgttgtagagatggttcacagtgtgggcaaccaccacccccttttagctgcctttgtggaagaaatattgacatcacaagatcaagtggagcaagtggttaatctattgcacccaagtcaaacccaatgtgccctgaatgtcaaggccatcgatagtgcactgtcccaaacggttccccaatacatgattcctagcatgtatctacatatctcccgcctgcccctaagcgcatctggaaagctcaaccgtcgccacctgcgtaggttggtcgcagagtttccacgtcagagactcagtgaatacgctgctggatcaggcctcgcagtcccgaaccggccggcaacagctcaggagcgtgaaatgcaggctatctgggcgcgagtattgtcagttgacccggacacaatcggagtcaacgaagactttttccgcatcggcggcgactccatttccgggatgcaggttgccacgagatgcaatgcggcaggcatgcatatcaccagtgcggatctcttccaacaccgtaccatcgagcaactgatgcgccatcttagtgctaatggaaagactggctccgcgtcaatctcactacctccagagccggtggacgagtgggttcctcttgcccccatccagcaactcttcttcgaaatcgccccacagggtccagatcacttcaaccagagcctgctcctgcgcactagccgccgggtcagtgcagaaaaactcgccggaggcctagatattctcgtgggacgacattctatgctacgcgcgagattttgtcgcgatgattccggccaatggtcccagcaggtaaggtcgcgcggcccgtaccctgctagtgcattttaccggttgaccacacacaaccacatcgctcctgagttgctgtcgtcacttcttgctgcgtctcagatggccttgtctattcaagaggggccgctcttagccgttgatctggtgaatttgacggacgatactcagctcgtctacttggtggcccatcatctcattatcgacctggtctcgtggcgcatcttgcacgcggaattggaggaatatctgcagacgggctccttcgcgtccaccacaggctctgtccccttcttgacctggagtcgagcacaggccgaatacagcgctaatcaccttactcccacacttcctctacctggcttccaggaagcaaacgatggcttcgatgcctcgaggtactgggggatttcttgcgagtcgaacacattcgggcaaacctccacttccacgttcaccttggaccagactgtgaccgaccaactcttcggccccgctaacaacgtgcttgatactcgaccagctgaaattttgcaagctgccctctggtactctttcactcaatctctcaccgaccgtccgggtcccagcatctacgttgaaggtcacgggcgagaaccgtggacgggttccattgacctttcgggaacggtcggttggtttacaaccatgtctccgctagtgtccgctccgtgggatagcctatcacagacatcgatgcgggacttcctcgatgcgctcagctatatcaaggaccagcgccgacgcattccggctaacggatgggcgtacttcacctcacgatatttgaacgacgaaggcaaggtcgcgtatgggcgcatgaagccggtcgtggaaattctgtttaactatatgggccagtaccaggagatgaaccgtgaggacgccatactacagctggctggcgatggcatccagtccggtaccggtgctgcagacgttgcggacaacgtaccacgcttttcgttgatcgacgttagcgcgttcatctcgaacggatgtctaaccttccagtttatactccctaaatctttgcagcaggactctcgactgcaagggtgttttcaggaatatgaacgcactctcgtcgccgctgctaattcactgtcaactgagggcccccgcaaaacattggccgactttccccttatgcctgcactcacatacgatcagctaagccagtgccttgatcatacgctgccttcgatgggtttgtgtgcccgtgacgttgtggacatctatccctgctcccctgtgcaacagggaatgttgttggcccagctgcgcgatcgacaggcatatcagcaacgattcagattccaggttaagtctcgcgggtcaacagaccgactcacattagaaaagctgaaggacgcttggactgaagtgatcaaccggcatgacatcctccgtactctccttctaccagtttcggattacagccacttggaccaagtagtcatggcccctggcagtcttcaacatctggttcggattaatgcgatggacaccaatcccacacagggcctaccacactcgattaacatcaccagcgactcaaccggcactgtaatttgcgagtggaatgtcagtcacgccttggtcgatgccatgtcgattgcggtcattcaacaggaggtcaatgaggcgctggaagggtcgctgggtcagcatcaaaaaacaccgcgatacgcagattacatccaatggctttctctgcaagacaacaccgagacacaggcgtattggaaaaagtacctcgagggagtggagccatgtctctttccaaaattggcttcttcgactgacaaagtcaacccggaaggtaccatttctgccattcgtgccacctggacccgcgattcgcggttggacaagctatgccatacgcacggtatcacattgacaaacctattccacattgtctggtcccttcttctcagcgcctatctaggcactgataaggtttgcttcggctatacgacccttggtcgagatgtgcctgtcgacggggtagagaagatggtcggccctctagtcaatgttattgccacaaccatccaacttcaagaggacgattcgatcttggatgcacttctcactcatcaaacccatctctcaaatagtctccaacaccagcattatgcgttggcagacgtgtatgcctctttaggtctggtcggttctcagctgttcaacactatcgtgtctttgcaggatatatctcacttcgatgccaacgacgagcggccgaccagggtcgaaatgctccctgcaaatgacgtctcagagtatgatgtggctctcaatatcggtgtcgatcaatcttccattcaagtggtctgcagctaccgaacactatcgctgtctgtggagcaggccgacgcgctactgcgaactacctcccatgtactggatgaaatcctgagggatcccaagcaaccgcttcgggaccttgaggtgattagcccccagtgtaaagagcaactcgtaaagtggaacgctgccatgcctgccccgaccgatgaatacatccatgagaagattcaggaccaatgccgtctccactcttcccgagaagccgcttgcgcctgggacggcatatttacgttcgctgaagttgacgacctatcgtcacgtctggcagcacggcttattaggatgggggttacctccggtcacatcataccaatctactcacccaaatcccgatggacggtcatcgccattctaggagtcctaaaaactggggctgccttcacacttctagaaacatcgcatccgacggctcgactgcgcgttatatgcaatgagatcaaggctgatataataatcgcgccagcatcgcatgccgtcccagcggcaactttggctcctatcctagtcgtgctcgacagcatcacgtcgatgagcccccaagaatcagatctcttaccagctgtgggtatgccaccggctgcagaagctctcgcctatctcatcttcacttcaggctccacaggaaaccccaagggggttatggtcactcatcagaatttgtgcagtaatgcgtctataatgacaacatctgtcaatatgacatccgacagcagggtgctacattttgcatcccatgcattcgatgcgtgtctttgggaaatatttggtgccctatttgccggtgcttgtctgatcatcccgtccgagtcagagaccaaggaagatctggctggttgtatcgagcgcatggtcgtcacttgggcatttctgaccccttccgtcgcaaggatcttaaagccagaggcccttcccagtctccgtaatttagtcctgggaggcgagccgatagcggcctcggatttagatatgtggcggggtcacgtacaggttgtgtgtgcctatggaccaaccgaaaccgccatcctcgccagtacgacctcaccctctacctttcccagcgatggcaaggatatcggcgtgccaactggtagctccctttggattgttgacaagcaaaattacaacaagctggcacctcatggagccacaggcgagctgctgattgagggccccaatgtgagccaaggatatcttggggatccagagaaaaccaatgaagccttcccagtcgctccacgctggctgtcacagctccgaaagtcgcctaccagggtctaccgaactggtgacttggttcgcttcaacacatctacgggcaccattcacttcgttggacgcaaggataaccagatcaagttccacggacagcgcatcgagctcggtgacatcgaacatcatgctcagcaggccttttcgaatgccagcatggtcatcgtcgatttgattacccctgaacagcctcaacaaccatatattgttgctttcgtacatcaagcagatacaaggactggaacggccgacccaattgacaccatcttgcttcctccctccgaatccttccgagcagacgcaataggagcgcagaaccacatgcacaaacgactcccgcactacatggtcccaacagctttcctccctttgcatcggcttcctctatcaggcactggcaaagccgatcgcaagcgcctccgacaatgtgcactctctctgtccagccttgagctcaatgcatatcgcgccacagcctccgcgaagcgtatgcctttcaccgcagcggagtgcaaaatgcaggaattggttgcaactgttctgggaagggacatgtccgagattggcatggatgacagctttttctatctgggaggtgactccatacaagcaatgcgcctggtttctgagggtcgtcaacaaggccttaccctctcccttcaagcaatctttgacgctccccgtctgggtgaccttgcttatcggacagccaacctggtcagagtgagcgagccagccccgcccacattgccagccacctcaagtgatgattgcgaccataaagagacaatagttgcagctctgcccatcaagaagactgacgtggccgaagtccttcccacaacctcttttcagcgcacctggctagactcacagctgaagagctacattgtcgtcgacatcccaggcccgatcgatcttgcacgtctccgtacggccatacagcgggtcgtgaaggcgcaccctattctccgagcgtccttcgtgccttatgaaaccacaaccatgcaagttatcctccgcacagcagtggtcatcacaaaggccgacctgtccaccactaccgtggaaggcatttgccgcaaggatgcaaatgccccaatggcccctggaacgccgtatctgcgcgtcatcctagcaactcaaggagaagtagatcgtaaactgatcatgcgactttctcacgcccaatacgatggtatctcactctccctactcatgaatgatctgagtcacgcatacgcaagcgagtctcgtccattaccttcatcccacttgcccgcgttcaacgactatattacctatcagcaaactcagggagccgaccccacagcgaccacattctggcatcgtctcctcaaagacgtgccaattacctaccttgatctccaaccagccgagaccccaaccagcaatggatccctcattacacgtacccgcgacattaatattgctgccttcccatcactccctaacggtatcaccacagccacagctgtcaaggcagcctggtcgctggtcctagcccagaagactggttcccttgccgttatatttggccaggttgtccatggtcggggaattgcgcttaccggggttgagggtattgtcggtccttgtgctaatattacgcccgtcgttgcacgcctgggtcctcaaactacaagaatggagttaatgcaaacgttgcaagaccaacaccgctctgctatgccatatgagacggccgggcgtaaagagttgcaaacaatcgtgcagcatcagaataatgtgatggctgacgatatggaactgtcgcttggagaggcaaggtgtcgggtcgatctgagggcagtggatcatgtgccacaagaggtatgggtatattcgtctatcgatgggggaagaccgggtatgttggaggtgaagatcatgtcgtcgacgttggtgttgagtgaggaggttgcggaagagttgatggatttgcttgtagagatgatgaagaggttgtttagcgatcctgagggtgtgtgtgtttga

SEQ ID NO: 3 - RNA, 15165 nt, Aspergillus niger
augagucgcuuuucuugcaucuucccuacccuaacggauggguaugucccaaaucuagaucaaacucgugccgcaggucggcgaacauacacgaucgaccggagaggauggaccgccccaagcagucagacagaaucgcacauccuagcagccuggggccuuguucuauccagcuacguaggcaccgaugaaguggcuuucuacauugugccaacgacugguccggacacaacagcauuggcugaauugaaggucgagggagacaugucucgccggucccucaucaacgcugccgagcaguuguugcacccaggacccgugggugccggccaggugucuggggagucugccaauacgauaaucaccuuugagaaggauauugagucguuauuuguuacucaggccgaggcagcaaaugugggcacugcgauggcccaggcgcucgccgaggugggggcagacgaccacaauagguuaaucaagaaccucaaucucaugagcccgacacaccuggaaagcaucuggcaguuuaaugccaauguucccgguaugugggaggagugcuuucaugaugugauugagcgucgcgccgcgaaucgcccacacucccuggcggucgaugccugggauaugaagcucaccuacgccgaccucguaagggaggcacgucugcucgccgcauaccugcagcaccgcggcgugcguccaggauccgugguccccauuucauucgaacggucgggagcagcucugguugccaugcuggcuguguccaaggccggcggagccuuugucagugugccaccgacucucccugcuggacgacucgacgccauucuggaagucaucgaagcaccguuugugguaacuuggucgaaguacgaaccauucugggccgaacgccucccuacgcucccuauagacagcuaucccaagccaucugcagaugcgacggugaaaacccucggaaagcccgaggaccuuuucuauguaauuuucacuagcgguucgacaggccggccgaaaggcugcaugcugucccacucgaacuggcugaacggcgcgcuucguaacgcuccuaguuggaaguauggucccgagagccguguccugcaaaugcugagccacaccuucgacaugagucugcuggagaucugcaccagucugggauccggggccugcgugugugugccacgcacagaggaaaucgaaaccagcgucuccgaugccaucaacagguggcagguuaaucauguuaucaugacaccuucacuugcccgcuccuugagacgcgacgacgugcccgggcugaagacaaugugccuugguggugaagccuuccccagggagauugucaccaugugguccgagcggauuaaucuguggcaauucuacggccccagcgagugcucaauuaacucgucaucgcggccaaucacacggcccgaugcggauccguugaauaucgguccucccaacucggcugcuugcuggguaguagauacucaagauuacaauaaacugguucccguuggugcuauuggagagcuacuuguuucuggaccuauugucggcaugggauaucucaaaaaucccauuaagacagccgaggcuuuccuugaugaagucggguucguggcgaaggaugauccccaguuugguggauuccgguuuuaccgaacaggugaucucgugcgguggaacucggacgguacuaucacuuucugcggccgugcugauacgcaagucaagcuuaauggccagcgacuugaacuggccgagguggaauaucagcuggggcuggaagcuggcguucaguaugccauugcaauggcaccucaaucuggucggugcaagaacaaucugauugcuguucucaccgucaagugcggcggcgcuagcaaccaggguaaugcugacgacgaaaucccacugcuggaccgccacgauccgauuguccagcagaccguuaagaagcugcguucgcaacuucagcacgcucugccgcgguauauggugcccaccaucugggcguucguugggcgcaugcccaugucaccgucuggcaagauugaucgcguacaacugaggaacugggugcaagagaugagccaggagacguucgacgcaaucaccggucgaaguuucgaggcggaagaucauguucucggccucagccagcuagagcaggagauccagcucgccugggccgaagcucugggucucuccgccgcugaggugggcuugcagcagccauuugucgcgcuaggcggggauuccaucaaggcccucgaugccguagcuagaugucgggcucgucagaucaagauuagcauggugcauaucuugucuugcgaaggcguccgagaggcuuccucgcuggcagaagugcaggagaccccugcucaucagguggccgagaucgcgguggauuacucggaucuguggacccgucuguccacugaauaugacauuagcaagcugggcgucacgcagguugaagagguggaggaugucuuccccugcacaaccaugcaagagggcauguuccucggccagauccgucggccuggagccuaccacaugcguuuuuuccaccgcguucagcugaagggugguucccuaccgaccguugaacgcauccagcaggccugggccucccuugucgagagacauccuucauuacgcacagucuucguggaugaucuguccucagaggccauuuaucauucggucgugcugcgguccgugccgauggagcuuacaaugcgugaggugccgcgagaccucaaccccgaaucggcccucgcuauguucacggaggagcucgugcccuuucguccuaaugccccauuacaucgcaugcuucugcugaccugccgcggacgcgucccauaucuuaugcuggaaauuucucacgucaucauggacggcuaugcgcugucgguuuuccgacgcgaguucauccgcgccugcuccuccacugccucccugccgcgaggcccagacuaccgcauguuugccaacuaccaucgcacacgacaaaccgacgagagugcaaaguauuggacaaauuaccuagccgacugugugccaugccacaucccuacggauccguugagugugccgacggaugccuccccugaauggccucggacgcugcagcgccgcgacuuuggcuucgacaacagcguagcguuccugcagcgaugcaaagagcgccagguuacacucgcuugugcgauccgcgcugccugggcgcuggugcuacgcgccuacacccaaucacgggauguuugcuucggcuacgucuccuccgggcgcaacgugccggugcccgaggucgagacuauuuuugguuugugucucaguaugcaggucugucgcgcaaagcuaagcgaggcuuccacaaucgcuagccucgcuaggaagauccaggaggauuauguugcuagcuugccauuccagcacuacccauuggcagaggcacaacgcgggcugaagcaaacacauggacaggggcuguucaacacggcgaucuccauggaaugggugccuccgacagcggaggaugaggaugccuugcuggauuuggaggagauucgugaacaggaugacccgacugaguacgacaucgccaucaguguggauauccacgaaggccacaucaaacugggcuuccucuauuggcccaacuugagcgacuuccagauuacccaucucgccgaggcccuccagggugccaugaacugcuuugccuuucagccagacguggcccugaacacucucacucuucugcaggccagugauuugugcuccacccuaacuaacggaccuacccugcugccucuagaagccguccgcggcaacgugauaucgaugauagaccgcugggugacccgccagccggagagcccugccaucgacggcugggauggaucccugaccuacaagcaacugcacgagcaauccuccuggguggcucgcaaucugcuucaucaagggguaaaauugggagaccgcauccuggugugugcagaccggucaagucgcacugugguaacaauucuaggcgucgugcgggcaggaugcgugcuggugcucucgaacccgacggacccggaaaagcgccugcaguggcuggcacacaagugcaaugcuacccuggucguugcugauccugcauacgaagagcgguuugcgacuuccggugcucguguauuuucaacaaccuccguuugugcccccgcagccugggacuacgaguucucagcucuggacgaucaggaccuugucagcauccucuuuaccuccggcagcaccggcaccccgaaaggcauauugauggaccauggggcacucgcgaccaguguucuccugggccauggccgcacguuacgcuucucacgccacacccgcaugcugcauuuugccucccuaacuuuugacgccgcucuggcggagaucuuuaccaccuuggcacaugguggguguaucugcgugccgugugaggaagaccgucucucugacgugucggguuguaucucccgcuuugcggucaacaccgcuaugcugacacccuccgucgggcggcugcuggaucccgaggcucugccaacgcugaaggcucuggccaugaucggcgaaccgaugucccgguuggauguugagcgguucgccccgguacuugaccucuacaauggugcaggaccuacggaaacauccauaaugguaacaauugccgggccgaugaaaccgacugaugagccagugaaucuggguuaugccguggccggcguuaggcugugggugacugaggcugagaacccuaaucgccuggcuccguugggagcagucggagaguugaucgucgagggccgcuuggucacucgcggauaccuggaugauccagcacgcacuagggagucuuuccuucccaauuuaccauggcuuccgucucagcaugccuuguaccgaacaggcgauuuggugcgcuaugcggaagauggcagcuugcgguauaugggacggaaggacacgcaggucaaguugcguggacaacgcauugagcuacaagaggucgaguaucaucugcgaaagagcuuacagcaggcacagguugugguggagauggucauuccagaggggaaaauucgugcucaggcaagcuuaguggcuuuugucagugguuugacagcggcagauguugagucgucuucggcgcguaacuuugaccagucgaugcccaugucacaaaucgccuugcccggcaguacgauccaagcgcuugaggaagcccugccucgcuauaugaucccgucgguguauuucgcccuggacacgaucccgcucucagucaacggcaaggcagaucggcgaagacugcgugagauaggugccgcgcugcugguauccaguaccgcccauaagaacacuguugauggaaagagcgagccugucaaauggacagcaucuucgaaauuggagcugacacuguuggaauuguggacuacgacacuuggacuugaggcugaaacaaucuauggcgaugauagcuucuuugaauuaggcggcgacucuguuucugccaugaagcugguggccacggcucgggauagauucaagcugucguugaguguuccucaaauguucagacaccccacuauucaucagcuugccgccauacuuggggaggccacugggcagccagaaagcucagcuucguccacgacugaggaaggauucacauucagcacgccagaugacuccuccaccaaugacggggucgaugacgauuuucuacggcuggccaccgcucagcuugcccaacuggcgcaagagaaggguaagaagguggauauugcugcucuucuaaagcagcugcaaggcgguuccucuuccuguaagaccccauccgugucuuccuccucaucaucgucgucgucgaggaagaagaagucagccaaagugguguccccagucgaagcaccugcuccugucccagugccauuuuccuuguuggauggcggcgcugauguuguagagaagauucgugcacaggccguggagcagugcaagauccuacccggggauauugaagauauuuaucccgccaccgcucuacaggaggggaugauggcgcugauggccaggacacccgggguuuauacaacaacuuuaacaugugagcucccugagcggguuaaucuugcacggcugcacuccgcaugggauaaagcugccgaggcgcauccaauuuugcggacgcggauuauccucaccgaaaacaacacggcagugcagguugugcagcgugcgaaagagcuuccaugggaugccuauucccuucaggauggcgacccucugccagaccuaacgucgaacaugacccuugguucuacccuucugcgccuagcugagauacaccggcaaaaccagccucggaugcugcugguggccauucaucacgcucucuacgacggauggucaaugccacugcucaaacaggcaguugaggaugucuaucauggacaggaguuguggccacagcccuucaccccauucauuaauuaccuaaaugagggaaagccggcggcacaaggcuacuggaccgcccaccuggacggcuucgcaggaagcgucuucccuaauuugccuagcauaaaccaccauauccagccgacggagcgucgaacccgcucacuggccgugccgacagcgccccccggaucgcaguauacuauggcgacaaaaauccaagcagcgugggcugucacgguuucgcgauaugcagaggcugaggacauugucuuugguaccguuaguaccggucguucggcaccugugccgucgauugaucgcauggucggucccaccaucacgacugugccuguucgcaucucgcucggcaaccaggcagagcgucucaccucacugcugcagaggguccaagaggauggcuggaacaggauggaucaugaacaccugggccuccagcacauccgccgucucggugaaucugcugcugcugcuuguaaccuccagacgcuguuaguaauucagccucgugaagagccucgugccaaauccauuuccaccuuacuuucaggauugcaagacguggcugaacucaagggcguggauacguauccgcuaauguuggugugcgagccugauggugucagucugcauuugacugccguguuugauccagccguccuggacgcagucaugcuggaccggaugcuugcucauugggagcucguucuaaaucaaauauggagugagccggacauggcagugauggggcuugauggcguaucauacagggauaagcagacauugguaagauggaaugcuggagaaaagauugcugauggaugugcccaugacgcgguguaugaguggaguguccgcaccccucaugcacccgcugucuucgcuugggaugguaaauggaccuacgaggaacuggagaagugcuccucucucauagccagucagguccuaguccauggugucuccuccggagacuuuguugcucuuuaccacgagaagucucgaugggcggcggccgcaauucucgcgguguucaaagccggcggcauccugguuaccuuggacccggcccaucccaaagacagaaucaaggauauccuggaucaagcacggccgcgacucguacugaccucucagucucuccucgaugaggcuagagaacuugagaccccggucaugguuguacaguucgcagcaucccaaccaaugcccggagaaugcuucccucuacccacaguaagccccacccaggcugcauaugcuccguuuaccucuggaucuacaggucgaccaaaagggauuccauuagagcaucggggacuggcugcuucaacugcuucaguagcucgugccugccuacugcgcccagcaucccgaguccuucauuuugccagcuucgccuuugaugccaguaugauggagcaccugauagccuggcacgccggcagcugucucuguaucccgguugaaacugucaggcagacggaucuggccaggugcauacgagacuucgaaguuacuugggcuuuucucacaccuucaugccuacggcuaaucucccccgaugauguucagucccuugaagcccugggucuagguggugagucuaugacgcccgaggauauuuucaucugggguccgcgacuccgccagauuguccagcuauacggcccggcggaguguuccauuguggccgcguugacagaaguuaccaagccaucggagaaccgauugauagggagacccaaugccugucgaugcuggguaguugacccacacagcccagaucgccuagcgccccuaggugcugucggagagcugguaauugaggggaucacugucggucgggguuauauugacgaucccgagcgaaccacccaagcauuuauaccacccccuacauggauucaaacacuguauccgaaugagcaacagccaagucgccucuaucggaccggugaucucguacgguaugcugguacggacgggaagcugaccuucaucgggcgaagggacggccaacucaagcuucacggacaacguauagaguuggcggacgucgaagcucaccuccguccucuaauacccggcacgcagaagguuguuguagagaugguucacagugugggcaaccaccacccccuuuuagcugccuuuguggaagaaauauugacaucacaagaucaaguggagcaagugguuaaucuauugcacccaagucaaacccaaugugcccugaaugucaaggccaucgauagugcacugucccaaacgguuccccaauacaugauuccuagcauguaucuacauaucucccgccugccccuaagcgcaucuggaaagcucaaccgucgccaccugcguagguuggucgcagaguuuccacgucagagacucagugaauacgcugcuggaucaggccucgcagucccgaaccggccggcaacagcucaggagcgugaaaugcaggcuaucugggcgcgaguauugucaguugacccggacacaaucggagucaacgaagacuuuuuccgcaucggcggcgacuccauuuccgggaugcagguugccacgagaugcaaugcggcaggcaugcauaucaccagugcggaucucuuccaacaccguaccaucgagcaacugaugcgccaucuuagugcuaauggaaagacuggcuccgcgucaaucucacuaccuccagagccgguggacgaguggguuccucuugcccccauccagcaacucuucuucgaaaucgccccacaggguccagaucacuucaaccagagccugcuccugcgcacuagccgccgggucagugcagaaaaacucgccggaggccuagauauucucgugggacgacauucuaugcuacgcgcgagauuuugucgcgaugauuccggccaauggucccagcagguaaggucgcgcggcccguacccugcuagugcauuuuaccgguugaccacacacaaccacaucgcuccugaguugcugucgucacuucuugcugcgucucagauggccuugucuauucaagaggggccgcucuuagccguugaucuggugaauuugacggacgauacucagcucgucuacuugguggcccaucaucucauuaucgaccuggucucguggcgcaucuugcacgcggaauuggaggaauaucugcagacgggcuccuucgcguccaccacaggcucuguccccuucuugaccuggagucgagcacaggccgaauacagcgcuaaucaccuuacucccacacuuccucuaccuggcuuccaggaagcaaacgauggcuucgaugccucgagguacugggggauuucuugcgagucgaacacauucgggcaaaccuccacuuccacguucaccuuggaccagacugugaccgaccaacucuucggccccgcuaacaacgugcuugauacucgaccagcugaaauuuugcaagcugcccucugguacucuuucacucaaucucucaccgaccguccgggucccagcaucuacguugaaggucacgggcgagaaccguggacggguuccauugaccuuucgggaacggucgguugguuuacaaccaugucuccgcuaguguccgcuccgugggauagccuaucacagacaucgaugcgggacuuccucgaugcgcucagcuauaucaaggaccagcgccgacgcauuccggcuaacggaugggcguacuucaccucacgauauuugaacgacgaaggcaaggucgcguaugggcgcaugaagccggucguggaaauucuguuuaacuauaugggccaguaccaggagaugaaccgugaggacgccauacuacagcuggcuggcgauggcauccaguccgguaccggugcugcagacguugcggacaacguaccacgcuuuucguugaucgacguuagcgcguucaucucgaacggaugucuaaccuuccaguuuauacucccuaaaucuuugcagcaggacucucgacugcaaggguguuuucaggaauaugaacgcacucucgucgccgcugcuaauucacugucaacugagggcccccgcaaaacauuggccgacuuuccccuuaugccugcacucacauacgaucagcuaagccagugccuugaucauacgcugccuucgauggguuugugugcccgugacguuguggacaucuaucccugcuccccugugcaacagggaauguuguuggcccagcugcgcgaucgacaggcauaucagcaacgauucagauuccagguuaagucucgcgggucaacagaccgacucacauuagaaaagcugaaggacgcuuggacugaagugaucaaccggcaugacauccuccguacucuccuucuaccaguuucggauuacagccacuuggaccaaguagucauggccccuggcagucuucaacaucugguucggauuaaugcgauggacaccaaucccacacagggccuaccacacucgauuaacaucaccagcgacucaaccggcacuguaauuugcgaguggaaugucagucacgccuuggucgaugccaugucgauugcggucauucaacaggaggucaaugaggcgcuggaagggucgcugggucagcaucaaaaaacaccgcgauacgcagauuacauccaauggcuuucucugcaagacaacaccgagacacaggcguauuggaaaaaguaccucgagggaguggagccaugucucuuuccaaaauuggcuucuucgacugacaaagucaacccggaagguaccauuucugccauucgugccaccuggacccgcgauucgcgguuggacaagcuaugccauacgcacgguaucacauugacaaaccuauuccacauugucuggucccuucuucucagcgccuaucuaggcacugauaagguuugcuucggcuauacgacccuuggucgagaugugccugucgacgggguagagaagauggucggcccucuagucaauguuauugccacaaccauccaacuucaagaggacgauucgaucuuggaugcacuucucacucaucaaacccaucucucaaauagucuccaacaccagcauuaugcguuggcagacguguaugccucuuuaggucuggucgguucucagcuguucaacacuaucgugucuuugcaggauauaucucacuucgaugccaacgacgagcggccgaccagggucgaaaugcucccugcaaaugacgucucagaguaugauguggcucucaauaucggugucgaucaaucuuccauucaaguggucugcagcuaccgaacacuaucgcugucuguggagcaggccgacgcgcuacugcgaacuaccucccauguacuggaugaaauccugagggaucccaagcaaccgcuucgggaccuugaggugauuagcccccaguguaaagagcaacucguaaaguggaacgcugccaugccugccccgaccgaugaauacauccaugagaagauucaggaccaaugccgucuccacucuucccgagaagccgcuugcgccugggacggcauauuuacguucgcugaaguugacgaccuaucgucacgucuggcagcacggcuuauuaggauggggguuaccuccggucacaucauaccaaucuacucacccaaaucccgauggacggucaucgccauucuaggaguccuaaaaacuggggcugccuucacacuucuagaaacaucgcauccgacggcucgacugcgcguuauaugcaaugagaucaaggcugauauaauaaucgcgccagcaucgcaugccgucccagcggcaacuuuggcuccuauccuagucgugcucgacagcaucacgucgaugagcccccaagaaucagaucucuuaccagcuguggguaugccaccggcugcagaagcucucgccuaucucaucuucacuucaggcuccacaggaaaccccaaggggguuauggucacucaucagaauuugugcaguaaugcgucuauaaugacaacaucugucaauaugacauccgacagcagggugcuacauuuugcaucccaugcauucgaugcgugucuuugggaaauauuuggugcccuauuugccggugcuugucugaucaucccguccgagucagagaccaaggaagaucuggcugguuguaucgagcgcauggucgucacuugggcauuucugaccccuuccgucgcaaggaucuuaaagccagaggcccuucccagucuccguaauuuaguccugggaggcgagccgauagcggccucggauuuagauauguggcggggucacguacagguugugugugccuauggaccaaccgaaaccgccauccucgccaguacgaccucacccucuaccuuucccagcgauggcaaggauaucggcgugccaacugguagcucccuuuggauuguugacaagcaaaauuacaacaagcuggcaccucauggagccacaggcgagcugcugauugagggccccaaugugagccaaggauaucuuggggauccagagaaaaccaaugaagccuucccagucgcuccacgcuggcugucacagcuccgaaagucgccuaccagggucuaccgaacuggugacuugguucgcuucaacacaucuacgggcaccauucacuucguuggacgcaaggauaaccagaucaaguuccacggacagcgcaucgagcucggugacaucgaacaucaugcucagcaggccuuuucgaaugccagcauggucaucgucgauuugauuaccccugaacagccucaacaaccauauauuguugcuuucguacaucaagcagauacaaggacuggaacggccgacccaauugacaccaucuugcuuccucccuccgaauccuuccgagcagacgcaauaggagcgcagaaccacaugcacaaacgacucccgcacuacauggucccaacagcuuuccucccuuugcaucggcuuccucuaucaggcacuggcaaagccgaucgcaagcgccuccgacaaugugcacucucucuguccagccuugagcucaaugcauaucgcgccacagccuccgcgaagcguaugccuuucaccgcagcggagugcaaaaugcaggaauugguugcaacuguucugggaagggacauguccgagauuggcauggaugacagcuuuuucuaucugggaggugacuccauacaagcaaugcgccugguuucugagggucgucaacaaggccuuacccucucccuucaagcaaucuuugacgcuccccgucugggugaccuugcuuaucggacagccaaccuggucagagugagcgagccagccccgcccacauugccagccaccucaagugaugauugcgaccauaaagagacaauaguugcagcucugcccaucaagaagacugacguggccgaaguccuucccacaaccucuuuucagcgcaccuggcuagacucacagcugaagagcuacauugucgucgacaucccaggcccgaucgaucuugcacgucuccguacggccauacagcgggucgugaaggcgcacccuauucuccgagcguccuucgugccuuaugaaaccacaaccaugcaaguuauccuccgcacagcaguggucaucacaaaggccgaccuguccaccacuaccguggaaggcauuugccgcaaggaugcaaaugccccaauggccccuggaacgccguaucugcgcgucauccuagcaacucaaggagaaguagaucguaaacugaucaugcgacuuucucacgcccaauacgaugguaucucacucucccuacucaugaaugaucugagucacgcauacgcaagcgagucucguccauuaccuucaucccacuugcccgcguucaacgacuauauuaccuaucagcaaacucagggagccgaccccacagcgaccacauucuggcaucgucuccucaaagacgugccaauuaccuaccuugaucuccaaccagccgagaccccaaccagcaauggaucccucauuacacguacccgcgacauuaauauugcugccuucccaucacucccuaacgguaucaccacagccacagcugucaaggcagccuggucgcugguccuagcccagaagacugguucccuugccguuauauuuggccagguuguccauggucggggaauugcgcuuaccgggguugaggguauugucgguccuugugcuaauauuacgcccgucguugcacgccuggguccucaaacuacaagaauggaguuaaugcaaacguugcaagaccaacaccgcucugcuaugccauaugagacggccgggcguaaagaguugcaaacaaucgugcagcaucagaauaaugugauggcugacgauauggaacugucgcuuggagaggcaaggugucgggucgaucugagggcaguggaucaugugccacaagagguauggguauauucgucuaucgaugggggaagaccggguauguuggaggugaagaucaugucgucgacguugguguugagugaggagguugcggaagaguugauggauuugcuuguagagaugaugaagagguuguuuagcgauccugaggguguguguguuuga

SEQ ID NO: 4 - protein, 5054 aa, Aspergillus niger
MSRFSCIFPTLTDGYVPNLDQTRAAGRRTYTIDRRGWTAPSSQTESHILAAWGLVLSSYVGTDEVAFYIVPTTGPDTTALAELKVEGDMSRRSLINAAEQLLHPGPVGAGQVSGESANTIITFEKDIESLFVTQAEAANVGTAMAQALAEVGADDHNRLIKNLNLMSPTHLESIWQFNANVPGMWEECFHDVIERRAANRPHSLAVDAWDMKLTYADLVREARLLAAYLQHRGVRPGSVVPISFERSGAALVAMLAVSKAGGAFVSVPPTLPAGRLDAILEVIEAPFVVTWSKYEPFWAERLPTLPIDSYPKPSADATVKTLGKPEDLFYVIFTSGSTGRPKGCMLSHSNWLNGALRNAPSWKYGPESRVLQMLSHTFDMSLLEICTSLGSGACVCVPRTEEIETSVSDAINRWQVNHVIMTPSLARSLRRDDVPGLKTMCLGGEAFPREIVTMWSERINLWQFYGPSECSINSSSRPITRPDADPLNIGPPNSAACWVVDTQDYNKLVPVGAIGELLVSGPIVGMGYLKNPIKTAEAFLDEVGFVAKDDPQFGGFRFYRTGDLVRWNSDGTITFCGRADTQVKLNGQRLELAEVEYQLGLEAGVQYAIAMAPQSGRCKNNLIAVLTVKCGGASNQGNADDEIPLLDRHDPIVQQTVKKLRSQLQHALPRYMVPTIWAFVGRMPMSPSGKIDRVQLRNWVQEMSQETFDAITGRSFEAEDHVLGLSQLEQEIQLAWAEALGLSAAEVGLQQPFVALGGDSIKALDAVARCRARQIKISMVHILSCEGVREASSLAEVQETPAHQVAEIAVDYSDLWTRLSTEYDISKLGVTQVEEVEDVFPCTTMQEGMFLGQIRRPGAYHMRFFHRVQLKGGSLPTVERIQQAWASLVERHPSLRTVFVDDLSSEAIYHSVVLRSVPMELTMREVPRDLNPESALAMFTEELVPFRPNAPLHRMLLLTCRGRVPYLMLEISHVIMDGYALSVFRREFIRACSSTASLPRGPDYRMFANYHRTRQTDESAKYWTNYLADCVPCHIPTDPLSVPTDASPEWPRTLQRRDFGFDNSVAFLQRCKERQVTLACAIRAAWALVLRAYTQSRDVCFGYVSSGRNVPVPEVETIFGLCLSMQVCRAKLSEASTIASLARKIQEDYVASLPFQHYPLAEAQRGLKQTHGQGLFNTAISMEWVPPTAEDEDALLDLEEIREQDDPTEYDIAISVDIHEGHIKLGFLYWPNLSDFQITHLAEALQGAMNCFAFQPDVALNTLTLLQASDLCSTLTNGPTLLPLEAVRGNVISMIDRWVTRQPESPAIDGWDGSLTYKQLHEQSSWVARNLLHQGVKLGDRILVCADRSSRTVVTILGVVRAGCVLVLSNPTDPEKRLQWLAHKCNATLVVADPAYEERFATSGARVFSTTSVCAPAAWDYEFSALDDQDLVSILFTSGSTGTPKGILMDHGALATSVLLGHGRTLRFSRHTRMLHFASLTFDAALAEIFTTLAHGGCICVPCEEDRLSDVSGCISRFAVNTAMLTPSVGRLLDPEALPTLKALAMIGEPMSRLDVERFAPVLDLYNGAGPTETSIMVTIAGPMKPTDEPVNLGYAVAGVRLWVTEAENPNRLAPLGAVGELIVEGRLVTRGYLDDPARTRESFLPNLPWLPSQHALYRTGDLVRYAEDGSLRYMGRKDTQVKLRGQRIELQEVEYHLRKSLQQAQVVVEMVIPEGKIRAQASLVAFVSGLTAADVESSSARNFDQSMPMSQIALPGSTIQALEEALPRYMIPSVYFALDTIPLSVNGKADRRRLREIGAALLVSSTAHKNTVDGKSEPVKWTASSKLELTLLELWTTTLGLEAETIYGDDSFFELGGDSVSAMKLVATARDRFKLSLSVPQMFRHPTIHQLAAILGEATGQPESSASSTTEEGFTFSTPDDSSTNDGVDDDFLRLATAQLAQLAQEKGKKVDIAALLKQLQGGSSSCKTPSVSSSSSSSSSRKKKSAKVVSPVEAPAPVPVPFSLLDGGADVVEKIRAQAVEQCKILPGDIEDIYPATALQEGMMALMARTPGVYTTTLTCELPERVNLARLHSAWDKAAEAHPILRTRIILTENNTAVQVVQRAKELPWDAYSLQDGDPLPDLTSNMTLGSTLLRLAEIHRQNQPRMLLVAIHHALYDGWSMPLLKQAVEDVYHGQELWPQPFTPFINYLNEGKPAAQGYWTAHLDGFAGSVFPNLPSINHHIQPTERRTRSLAVPTAPPGSQYTMATKIQAAWAVTVSRYAEAEDIVFGTVSTGRSAPVPSIDRMVGPTITTVPVRISLGNQAERLTSLLQRVQEDGWNRMDHEHLGLQHIRRLGESAAAACNLQTLLVIQPREEPRAKSISTLLSGLQDVAELKGVDTYPLMLVCEPDGVSLHLTAVFDPAVLDAVMLDRMLAHWELVLNQIWSEPDMAVMGLDGVSYRDKQTLVRWNAGEKIADGCAHDAVYEWSVRTPHAPAVFAWDGKWTYEELEKCSSLIASQVLVHGVSSGDFVALYHEKSRWAAAAILAVFKAGGILVTLDPAHPKDRIKDILDQARPRLVLTSQSLLDEARELETPVMVVQFAASQPMPGECFPLPTVSPTQAAYAPFTSGSTGRPKGIPLEHRGLAASTASVARACLLRPASRVLHFASFAFDASMMEHLIAWHAGSCLCIPVETVRQTDLARCIRDFEVTWAFLTPSCLRLISPDDVQSLEALGLGGESMTPEDIFIWGPRLRQIVQLYGPAECSIVAALTEVTKPSENRLIGRPNACRCWVVDPHSPDRLAPLGAVGELVIEGITVGRGYIDDPERTTQAFIPPPTWIQTLYPNEQQPSRLYRTGDLVRYAGTDGKLTFIGRRDGQLKLHGQRIELADVEAHLRPLIPGTQKVVVEMVHSVGNHHPLLAAFVEEILTSQDQVEQVVNLLHPSQTQCALNVKAIDSALSQTVPQYMIPSMYLHISRLPLSASGKLNRRHLRRLVAEFPRQRLSEYAAGSGLAVPNRPATAQEREMQAIWARVLSVDPDTIGVNEDFFRIGGDSISGMQVATRCNAAGMHITSADLFQHRTIEQLMRHLSANGKTGSASISLPPEPVDEWVPLAPIQQLFFEIAPQGPDHFNQSLLLRTSRRVSAEKLAGGLDILVGRHSMLRARFCRDDSGQWSQQVRSRGPYPASAFYRLTTHNHIAPELLSSLLAASQMALSIQEGPLLAVDLVNLTDDTQLVYLVAHHLIIDLVSWRILHAELEEYLQTGSFASTTGSVPFLTWSRAQAEYSANHLTPTLPLPGFQEANDGFDASRYWGISCESNTFGQTSTSTFTLDQTVTDQLFGPANNVLDTRPAEILQAALWYSFTQSLTDRPGPSIYVEGHGREPWTGSIDLSGTVGWFTTMSPLVSAPWDSLSQTSMRDFLDALSYIKDQRRRIPANGWAYFTSRYLNDEGKVAYGRMKPVVEILFNYMGQYQEMNREDAILQLAGDGIQSGTGAADVADNVPRFSLIDVSAFISNGCLTFQFILPKSLQQDSRLQGCFQEYERTLVAAANSLSTEGPRKTLADFPLMPALTYDQLSQCLDHTLPSMGLCARDVVDIYPCSPVQQGMLLAQLRDRQAYQQRFRFQVKSRGSTDRLTLEKLKDAWTEVINRHDILRTLLLPVSDYSHLDQVVMAPGSLQHLVRINAMDTNPTQGLPHSINITSDSTGTVICEWNVSHALVDAMSIAVIQQEVNEALEGSLGQHQKTPRYADYIQWLSLQDNTETQAYWKKYLEGVEPCLFPKLASSTDKVNPEGTISAIRATWTRDSRLDKLCHTHGITLTNLFHIVWSLLLSAYLGTDKVCFGYTTLGRDVPVDGVEKMVGPLVNVIATTIQLQEDDSILDALLTHQTHLSNSLQHQHYALADVYASLGLVGSQLFNTIVSLQDISHFDANDERPTRVEMLPANDVSEYDVALNIGVDQSSIQVVCSYRTLSLSVEQADALLRTTSHVLDEILRDPKQPLRDLEVISPQCKEQLVKWNAAMPAPTDEYIHEKIQDQCRLHSSREAACAWDGIFTFAEVDDLSSRLAARLIRMGVTSGHIIPIYSPKSRWTVIAILGVLKTGAAFTLLETSHPTARLRVICNEIKADIIIAPASHAVPAATLAPILVVLDSITSMSPQESDLLPAVGMPPAAEALAYLIFTSGSTGNPKGVMVTHQNLCSNASIMTTSVNMTSDSRVLHFASHAFDACLWEIFGALFAGACLIIPSESETKEDLAGCIERMVVTWAFLTPSVARILKPEALPSLRNLVLGGEPIAASDLDMWRGHVQVVCAYGPTETAILASTTSPSTFPSDGKDIGVPTGSSLWIVDKQNYNKLAPHGATGELLIEGPNVSQGYLGDPEKTNEAFPVAPRWLSQLRKSPTRVYRTGDLVRFNTSTGTIHFVGRKDNQIKFHGQRIELGDIEHHAQQAFSNASMVIVDLITPEQPQQPYIVAFVHQADTRTGTADPIDTILLPPSESFRADAIGAQNHMHKRLPHYMVPTAFLPLHRLPLSGTGKADRKRLRQCALSLSSLELNAYRATASAKRMPFTAAECKMQELVATVLGRDMSEIGMDDSFFYLGGDSIQAMRLVSEGRQQGLTLSLQAIFDAPRLGDLAYRTANLVRVSEPAPPTLPATSSDDCDHKETIVAALPIKKTDVAEVLPTTSFQRTWLDSQLKSYIVVDIPGPIDLARLRTAIQRVVKAHPILRASFVPYETTTMQVILRTAVVITKADLSTTTVEGICRKDANAPMAPGTPYLRVILATQGEVDRKLIMRLSHAQYDGISLSLLMNDLSHAYASESRPLPSSHLPAFNDYITYQQTQGADPTATTFWHRLLKDVPITYLDLQPAETPTSNGSLITRTRDINIAAFPSLPNGITTATAVKAAWSLVLAQKTGSLAVIFGQVVHGRGIALTGVEGIVGPCANITPVVARLGPQTTRMELMQTLQDQHRSAMPYETAGRKELQTIVQHQNNVMADDMELSLGEARCRVDLRAVDHVPQEVWVYSSIDGGRPGMLEVKIMSSTLVLSEEVAEELMDLLVEMMKRLFSDPEGVCV

SEQ ID NO: 5 - protein, 4 aa, Aspergillus niger
  PEPTIDE (1)..(4)
  PEPTIDE (1)..(4): Cyclic tetrapeptide
VVFF

SEQ ID NO: 6 - protein, 4 aa, Aspergillus niger
  PEPTIDE (1)..(4)
  PEPTIDE (1)..(4): Cyclic tetrapeptide
VVFY

SEQ ID NO: 7 - DNA, 20493 bp, Aspergillus niger
aattttccatgaaatgtccagtctattagtgaatacaggcaaaataaaaaggtatctcttccgatgagcgggtctagcccttgataacactcgcgtctgagctgtcattcactcatcccctgcccacaaacaacccgcaaggctgaagagcaaaaaacaaagaacccgaagccaagaccagccaagcctaagcctaatacccgtaaggaaagaaagcaagcaagcaaacaaactcttccacgtaaccacctcatacacatcaccccagtcacatcaccccagtcacatcacccctcaatcccctgcactcagcctcattctccaaagaaaatgaatctaatctagacacccttaccgccgcgactccacttagccaacgcccactccctagcccccaaaatcaacccggggtggaacaaagtcaacaacccacaagccagcaccatcatcgctccctccagcaccatgaacgtaatctcctcattggccaacttgccgccaaatccaccctgtagctcagcacaccggaacacgctccgcacaaagataaacaagacggccagagacagggaaacaatgaaccacggctcgaaggaccgctgtgcgcgcagcgaatcgaacgccgggttgagagggactcctttgcggctagcccggctcacgcgcagatagaagtccagacccaggcacgagaagatgaacagcgacaccacctgccacgcaaggccgccgaccatgacgtgcacaccctggtcctgcatggatgagtaggcgtcagcgacggaggcgacggcgccgcccacggcttgcagaagaagggcgatgatgtcgaaggtgatgaagatgtaggtgtagacctgggggcggaagcgagcgtgctcggcgccatagatcgtgatgatccgcgatagggtcagatagatggctgcggagatgaaggccggggcgatggtgagaggaacgagatacctgtcatggttgttaattttcacaccttaggttttattttagagggaaactcacatcaggaaccatgagaattcgaacatcgagtagcggaggagaatccgtccgacgtagcccaagacttcaagaatcaaaccaagtgtcatgccaatcatgtatccccgggtcttgcgcgagatgccgaagaagagctgcagcacgagaaagaggccgaagaggactgcgtagaggacgttgcccgccagattcgggtagtatcgcacccatgacagctgctcgccgtccaggacgagaggacaggtgcatttcgtacacaatgaggtatcattgagtagagtctggttgaaagtagcgagcgtgacattgctccaatcggtagtgcagttcgtcatggtgggcaatggggtctgtggatatgagaagggaaaagaaaattcgttgtggagatggggggagaaagagagcaggaaggaagaaaagtgagctaaaagacaaccagataagcttaatagaagtaagaagtaagaattaagagtaagaaacagtggacagaggagtctgaaaacagtgtgagaggttgatctggtgctggggccgtaactgcttactatatagtctgaaactgtatagtaagcaatcctgcgacagggatgtgttaccacagccactcttgcgcgtctaaaccccaacaaagaaaacaggcatcgaaattcaaaaataggcatcggaattcataacaaatagtaagccacagcctcagtcccttcactgcgggggccggagactagcctgattaaacaatgataataagccttactgctaagccccacgtggtgtgaatacagctggagtcgagtatagagccctaggctacgatataacccagaggcggagtagcttcaagtatcctaactttagatttttccatacatctttcactctattgctgccatattgttgctgcctgaatcctactatcgttaatcgaccgaccgctttttgccctaacgcctagacccataatctctatcaccatgtttactcaagccacttctactacccttgtcgagaacgtcggcgtctcccatcgcgagaaccccgacaccgagattgccgctctgatcaacgctgcctggagcatcgtggtctggcagtataccggacaggaagacactcgcttcatcaccgccactacatcgggagaggccgacgatcttgaatccacctaccaagtatgcaacgcacagctcgacggcgcaacaacaatctccgacttcatccaacaaacaccccaagcgacaaaggagctggcctccgaccaggtccctttggccccctcacgaaatgaggccgctacctcgccattcctgcaatcgattacgaccctcacctccaacaagacctatctcaactcctcctctcccagccatctggatgctacgggcgcactaatcgagctcgtggctattcctctgccatttggcaagctcgaatttgtggtgcgttttgcgccatctaccatcgaccaagaacgagccgatcacctcgcggctgcttttgcgcacgttcttaatttgatcaatgaccccgaccggcgacacgaccgcctagatgccatcgatctagtcagtaactacgataaggcaaagctttggacctggaatagcgtccagctgccggagacggtcgaatcatgcgtccatttcctcttccgccagcgcgcgcaggaggaaccggacatgctcgctgtggacgcctgggacggccgcttcacgtatggcgagctggacgatatttccgatcgcatcgcagtctggctagcccgagaagagggcatccgaccggaatccattgtacccctgtgctttgagaagagccgctgggccatcgccgccctgttgggtgtgatcaaagcaggtggtgctattgtgtttattgacccagctaacccagtcagccgcaggcaagatatcatggatcagatcgaaggtaagtgggtactgagctcgaaaagccaggccgaaacatgggaaaacgaaatgggcgtgcgaaccatcgtcttagacgagcaatttgccgcctccctgccggtcgaggatcatatcctcgagtccggcgttacccctaacaacctcctctaccttatttttacttcaggaagcacaggtaagccgaaaggctgcctcatcccgcacaaggcattcatctcaggtgcccttgtacacgcctctctatccaatctctcccgcggtagtcgtgtcttgcagctcgcctcgtacagtttcgatgtgagcatgttggagatcatgacttcccttatctcgggtgcatgtgtatgcaccccagacatggcgagcatggcccagggtctccagcccatcttcgacaaattcgacatcacatgggccttcttgacgccgtcgctagtcaagctgctgcgacctgagatggttcccaacctcaagacgctcgccctaggtggtgagccactcagcaaagtcgacatcgagacatgggcaccacacttgcaactaatcaacggatacggtccatccgagtgttccgtcgccgcggcgggcgatccacatctaaaaccgacgagtgatccatcaaatatcggccgcgccgttggcggcctttgctggatcgtggatgccgaaaatcacgaccggctcgtcccccttggcgccgtcggcgagctattgatctccggccccattctcgcacggggatatttgaatgatgcggaaaagacggccgcctccttcattgagaacccgacctggaccgaaggctggtcgctgacaccatcagacgcgaccgtctcaagtgaaagcgcatccatgcgcttctacaagaccggcgacttggcccggttcaaccttgacggcaccatccagatccttgggcgcaaagatacccaagtcaaacttcgtggattacgtgtggagttgggcgaaattgagcacaacatcgctcgccacccccacatcaaacatgctgcggcgttcctccccaagactgggcggtgtaaggagaaaattgtcgccgttgtatgtctcaaagacttcgctcaggactccaaatctggtcgatctgatgcgcccatcaacgtgctgtttgaagatgagaggccagatgttaaggatcaggccgatgccgttcggaaccacctgcgcgaatgtgtgccggaatacatggttcccgccgtctggatcgtgatcgaggcatggccgctattggtgtcggccaagctcgatcgcaagcgggtctttaactggttgttggatatggatgagggcctgtacaatcaccttttgggtttgctcggtactgacgtgtcagaaaacggctcttcggatgagaagtctgacgcccatctgtccgaggttgaacgaacccttcgcgacatctttgctcatgccttgaacactcccgctcacggtttgccgctggacaaatctttcattgcgcttggtggcgacagtctcgctgccatgcgtgtgatctcacaatgccagcgtgccgggttgaatgtgacagtcccggacatgatgaagagtaaatgcatcaaggacctggctgcccgtgtggagaagacccctgggatgaaaacaaagccagatcttttggatgtctcatttccactttcgcgggctcagcagttctgtctgggtgacgggagagcggcaaaccatctcacgcagagcattcttctgaaactggatagcactgtttcggccgctcgtgtcaaggctgcgttggaagccattgtcacccgccactccatgttgcgggcgcgctttggtgaatcagaaggaaatggcgccctgtctctcagacagacggtcacctctgagatcgagggttcttacagctttcagcatcaccgcatagaacgtcctgaagatatcaccaccatcgcagccacagcagacgccgtgtccctctctgggccaattttctccgctggtctagttacaggagcggaaaagcaactattggtcttgagagcccacagtgctgtggtcgacggtgcctcctggagcatcatcatccggcagctccagacctgcttgagtctcccagatgggcctcttctgggcgaagaggcccaggagccagtctctttccagaactgggtcagcgtcgagagagagacaacgggtgacgagattgcagtcgcgccacgcattctgctagcatcggaggttgacatggactaccaggcagtggagcttgaccaggcaacaactaccctgctcttgagcgaggaagtacacaagccactgcggactcacgtcgtcgacttcatgatggcaagtctgatgctttcatttaggcaaacatttggcggccgggagaccctacctacacttgctttgtgggaggatgagcgtggacgcgcgtctgaagattttggcattgacctctcgcaaaccgttggtcgattcgagactctgcgtgcattgaatctcgacacggccgatatgagcaccaacgacgcgcaagtgcgcatgttgaaggggatcaaggacgcccggaaaacgacaatggagccaagcagtattcagaacccggagatctcgtttcgctaccgtgatctgtcgaacattattgacggtcctcgcagccttgtgcaaatcaaaccgcgtcccgtctttctccctgcgcccggagcagctcctttggttagcaacatctccattgtggcggaagtcatcgatgagaatattcagcttgccttctcttttaacaagaaggttgttcaagagaaccaggtcaaggcgtggattgcgaccgcgcaggaaacgcttgcttcccttgttgtcaagatggtcaacgccccggttgaatacaccccatcagacttcccgttattgcacggaatcagctacaacaccctggacaagctcatcaacgaacaactgccccagatcggccttattcctgggcctgagtcttcgttgatcgaagacatttatccatgctcacccatgcagcaggacctgttgcttagccagcaccggtccgcggatgacatgtatgatgtctaccatatcgcggaactgaggccacgcgatcccagggagtcggtgtctgttgagcgacttgtgaagtcgtggacagaggtcgtgcagcgacacacgtctctccggacaatcttcgttgaaagctccgacagtgaggcacagttcaaccaggtcgtgctggcccgtacccagcctagcatctccatcgtggactgcaatagccctgacgaagatttcgcgtccgtccttgccaaccaagaccccatctcgatcagaggacccgagcctgcgcatcggttgtctatctgccgcattgcaggagccagtcacgttgtcatcaaactagagatgaaccatgtcatcgtggatggcgtctctgcggctgtgattgtccgtgatctactgcaggcgtatgatgggcatgcggcgcaattggagcctgcaatgccgttccgccactacatctcccacatccgcgagacgcctctggaatcatcaatcgacttttgggcagattacctcaggggtcagagtgcgaccatggttcccaggctggccagcctagagacagagaaccaaggtgagagacagttgaacgtggtgtcagttcccctgaaagaggagggcgtctcaaatgaggcgcttctcgacttctgccggagggcctccgtcacccctgccaatgtgtttcaggctgcctgggcactggtactccgggcttatgccgagtcgcccgagcaagtctgcttcggttacctctcagcaggacgcgacgctcccctcccaggcatccaagaaggagtcggtgctttcctcactatgctggtgagccgtctgtcttttgcaaccgaggagaaggagaacgaaggtgataagactgccaccgttactacattgctggacgcagtgcacattgttgccgaagactacgtcaacgccctgcctcaccagcacgttggtctctccaacatccagcacgcactccagacaggaggcagtccactcttcaataccatcattgcagtaaaccgtgatgttgacagcccagctgattcgtcactcatcttcaagaacatcggggatcacgaacccgatgagtacgccatcgtcctagacgtgcagctcaacggctctaacacggcgcgtgcttcactccgtcactggaccgatcacttgacggccaagcaagcaggcaatattgcgagtgcgctcggaaatgccgttcaagcaattataacccgcccggatacccctatcagcgaggttgaacttgtgggcgtcgcccatacggatcaactgttgtccttcaacacccaccaactgccacgggcaaaccgattgatcttcacgaatttcgagaagctcgcccgcgtgcagcctcacgctccggcggtgtgtgcttgggatggcgagtggacatacagccagctcgatgaggtatccaaccgcctcgctcactacctgcgtaccttaggggtaggtcccgaggccgttgtgccacactgtttcccgaagtcgggttggaccatcgtgacgtgccttgcgattctgaaagccggtggtgccttcgtcgggctggatccgacccatccaaaaaagcgactggagggtttggtccaagaagccggagccaaggtggtgtgtgtggcaccgcagaatcgggacttgttcgaagggtgcgacaacttgagcattgtggagatcacgccagagttcgttgctaagctcccttcaaagtctggcccggcatgcggctacatccagccaaacaatgcggcttgcgtcgttttcacgtctggtacgaccggtcggcccaaggctgtagtggtggaacatgcctcgatggcgaccctgtcagatctcatgggtccggcggttcgtatcggtccagaggctcgcgtcttccagttcgccagttacacctttgatacatcgaatcaggacattttcaccaccctccagcgcggtggctgcgtttgcgtgccgtcagatgaggaccgtgtcaacgatatccctggagcattgaaccgccttcgcgctaaccacgcccacttgaccagcactgttattagtctcatgcgcccggagcaggtcccccagctccgatggctgtttagcgctggcgagccccttacccgggagaacgtggagatctgggcgccagcagtcgagctttacaacagttatggcccggccgagtcatctgtcgccgtcacttgtactcccacccgtctgagcccgagtggcagcccagcaaacatcggtcaggcctttggttgccacgcatggatcgcggatcccaccgactaccacaagctgatgcctctgggtgccgtgggagagctccttcttgagggtccgctgctcgcgcgtcactacctgaacaacccagaacagacagcagcagcctttgtccagaacccccgatgggcgaagagtatgagtccggaccagaaccggcgattctaccgaaccggcgatctgtgtcgcttcaaccgtgacggcagtctgaccatcatcggccgccgtgatagccagatcaagattcacggccagcgcgttgagcttgaccacatcaagtacgaagttcaggcccagctcgcccagcttgatcaatcgagtctggtttccgttgatgctgtgatgcttccaaaggcccaaatccaggaccgaactttggtagcattcgttcagtttctcgacgaggcgcctgcgaagcccctggacactttgtccattcccatgactgagaggctcgcccgcctgttctccgacctgcagcgagccctcaagtcaagcctacctcaatacatggtcccggccatgttcgtcccaatcacgcagattccacgaaccgcgaacggcaagctggctcgtaatgtcctgcgggagataatcgctggtctttccgaggccgacgtttctcgttacatgctgcagggtgagaccgcgaagaaagccccgacgacaccccgtgagcagaagcttcaagccgcctggagtaaagtcctgaacttgcccttggagaaggtgggcgcttctgatgacttcttccaacttggaggcgactcagttgtggccatgcggcttgcaggcgctgcacgagtggcaggcatgtccttgactttcgcggacatcttcgcgaatcccgtcttgtccgacatggctcaagttgtacgaatgggcgatgaatctggagaacaggagacagatgagaaagcatttgaccttgtcccactgtcatccacgtcatcactgcagacgattcgcgccgaagcggcaacacagtgtggtgtcaggcctgatgccatcgttgatatgtacccatccaccccactacaggagggtctggtcgctctttcgatgcgacaaaccggagcgtacaaggatcagcgcatcctgcgcctcacagacccaaattacgacgtgtccagattccgccgtgcgttcgatgccgttgtctccgccgaacctattttccgaacgcgctttgtgagcgtcagtggcgccggactcctccaggcggtactgaatgtcccggttgactggatcaagcgcgacaatctggccgcgtatctcgaggaggatttgaacgctccggtgacgtatggaagtgcgctcatccgtctcgccatggtagaggagaacggagaacgttacattgtgtggtcaggacaccatgcactttgcgacggcttcagcatggacatcacattcgaacagattgcccacgcgatggcacacgagggttccgtggtctccaagccggtctccttcaagggattcatccgcttcttgcaggatcaggatcgagacagctctgccagggagtactggcagaagcagttccctgctgacggcgaggcaccgccccaatttccacccaggccacaaggccaccaggttgtccctcatcgtgcttgtcgcctacaattccagctgaatcgcccggctggtaccaagatctcagtgacgaactatctgcgcgccgcatggggtctcgtcgtggctcgacaccaggacagctcggacgtcctgttcggcgtgaccctttctggccgaaacgccccggttgcaggtatctctaccatgaacgggcccacgatgacaaccgccccgttccgtatgaccgtcccgttggatagcgatacaacggtagctcagtatcttgacgccctccaccaacaggccattacaatgatgccgtttgaacacaccggtctgcagaatattcgtcgtctcaatgagctggcccgtgcggctgtggacaatatgggacatcgttttgcggtggagcctagcatcagcgacgtcagtgaggcccttgacggcatggaaattgtatccgccgatcttccagagggcttttacaccgatgccttggtcattcgcaactatgaccacagtgatggagcaatcgtcgtggaagctcgctatgatcacaccttgatctctgaccgcgatatgcagagactgcttagccaatacaatcatgtggtccagcaactgaccagtcaaccggagacgtgcattcgtgatatccaagtgcttagccccgacgacatcagtgagatcatgtcatggaatggtgatctacctgaaacggttcaagggtgcgtgcatcaacttgtcgcagagcgagcgaaggagcgtccagacgctgaggccgtgtgtgcctgggacggaagttacaccttcggggaattggatggggtgaccgaacgcctcgcagcccatcttcagaacctcggcgtcggcccagaagtgacggtcgctctttgctttgacaagtccaaatggaatgtcgtctctatgctatccatcctgaaggctggcggttgctacacggccttgagtccggcatacccagccgctcgcatgcaggatatcctccaggatgtccaagcacccctggtactgtgctcaccccatcatgcagataagttctctggcatggcgcccaaggttctgccaatcgacgatgccagtttcgaatatctacccaagcaaacaacaacccatcgcgtcacctccgcagtgcaaccatccaatgcagcactgatcgttttcacctccggcagtaccggtaagcccaagggcgcaatcattgaacatcgtggtttgtgttccatgcagcactatgaaggacctcatgtacaaatgggaccggatactcgcacactacaattcgcctctcatgtctttgacgtgtccaactcggaggtttttaccaccttgatgcggggtggctgtgtgtgtgtgccgtccgagaccgagcgacttagcgacctcgctggcgcagttaacaagtacagagtaaactggtccttccacgttccaacaactgcagagacgctcgatccggagcagatgccaggcttgaagcatctggctttgggcggtgaagccatcagtcaaggcctatgtgaccgctgggcatctcgtgtgacactactcaatgtgcgttttctctacatctctctatttcggtttcatttgacctcagtgctaacccataacagtcatatggaccctcagagtgcagtatctggaccagtgtctcgcatctgcagccagggacttcatctccgaacaacatcggtcgtggacttggctgccggacatggatcaccgaagcaaatgaccacaatcgtttggtggcgattgggtgcgtgggtgaactctgtgtggaaggcccaatcgtcacacgaggttataaagccaatcccgaacagaccgctgctgcttacatcgagaacccagcatttgcgcggactctaggcatccaagccatgcgcatctataagacaggtgacttggtaaagtatgatgcagacggcaatatcctctatgtcggccgtaaggatagccaagtcaaggtccgtggacagcgcattgaactgagcgaggtggaacaaaacatcgtggcccacggcattgatgcagacgctgtcgttgtcgaaaaggtcttcttgaatgggaacaaagaccgcgtggctctggcggccttcctaagactcaatgcatcctctgagtcgactggtgcatctggggatgtcgaaagcatggacgtcgttcgagaccagctcgtcgccctcaagaaccacttattggacaccattcctcctcacatggtcccctctttctttattcctctacgatccatgcctgtgacacagacgggaaagaagaaccgcaaggcgctcagaacactcggtgcatctttgtcgtccgagcaaagacaacagtacactctcgacgatgaagccgattcatcaaacaccaacggaggtcgcgcatgcactagcgaagctgagaagcggctccgagcattgtggtctgaagtcctcggaatcttcccagaggagtcaatctcggccagcgataatttcttccacagaggaggtgattcaattcaagccatgcgacttgcggccgcggctcgtcgcgctggcaaagcgctggcagtgagcgacttgttccgcatgccgcggctgtaccaaatggccgagctctgggagagcagtgtgcaaagccaagacgcaaccattgcgcctttctcgctgctccagccagagatcgttgacgacgctattcaggaggccgttcgccaatgcaatgtcgatgcgagcgacatcgaagacatttatctctgttcggcactgcaggaaggtctcatggcagtctccactcggaagcagggctcctacatctcgacaagaatcttcgacttgccagctgatctcgacattgatcgcttcaaggaagcatggcaaaaggccgccgacgtcttcccgatcttgcggacgcgcattatcctcggtcgtgcctccgagtctctccaggtcgtgctcaaggaaaagctagcatggcagaccatcaccgatgagacatcctttagccttcccgtcattgagtacggaggccgtctgtgctcctttgcgatcgacgtcgaggcacgcaaatttgtcttggccctccatcacgctctttatgatggctggagtgccacggtactgcttggggctgtggaaaagttctacgcgggtgagcaataccaggtgggtccaggatataatgtcttcattcggcatctctctcaagttgatcaatccgagtcggacaatttctggaaaggtcagctcagtggtacacccgcacatttccccaagttgccctccaaaacatacgaggccaagaacagcgccaacgtctctcacaccatccgtctaccagcgcccgagcatcaacccactggaatactcaagtcaaccttgctccgagcagcatgggctatcgtgagttccaggcatgccgggtccaatgatatcacctttggtgcagcccaatcaggtcgcgactgcgctgtccctggcatcgtggaagttgtcggcccaactgttacgacggtaccggttcgcatccagatcaatgacgacgagaccatcgtcaacttcctccagcgggttcaagagcaatctgtcagcatgatcccgcaccagcatgccggtgtgcaaacacttcgacagctgggcaaagacgtccaacccgcgctcgacttcaccactttgttcgagttcggagaggattccaaccagagtggcttcatcactgagatagaaatgcctgagctgctggacggtttctggtcctatcctattgtcttcgagtgccatctggctcagagcggggagactgtcaacgttttggcacgacatgacccgacggtcattcccacacaccagatggattggatctgcaagcagttcgaacacgtcgtcgaccagctctaccgtatggcatctgatgggctcgaggctagaaaggttggtgagctcgacctcttcggcccaagtgactttacccaaatcgaggcctggaatgctagatggcctgtgggttccatcgacggcaaggcagttcacgaggccattgccgagcaatgccgacttcatccccagaacctcgccctctcaggctgggatggcgaaatgacctacgcccagctagagcactacgcgacaaagttagccaaggcacttgttctaaagggtgttggactcgaagtcatggttccactctgctttgacaagtccacctgggcgatcgtgtctaccatagctatcatcaaagccggaggcgtcgttgtgcatcttgggcctactcacccggcgaaccgcagaaaggagatcttgaaaacgatcggagccgagtttgtattggtctcgccgcaacacactggcatctttgatgatgcggctgtcacaaccatcccaattgaccgagagtatttggatcggctgcccgatgttgactacgtggaactgcccaaggtcaagccctccaacgcagtctatgtttgcttcacttcaggaagcacgggtcggccgaagggaattgtggtcgaacacggcaatctgcgcatgagcgcccaggcacatggtgctcaattcaaggtcaaccctggcaccagggtgttccagttctcggcttatactttcgatatcggtctcggtgacatattcatttccctccaacgcggagccaccatctgcacgccatctgagtgggagaggttgaacgagctttctggagccatcaccaaatataaggcaaacttcatgtcggtcaccccatcggtggccaaacttctccgcccagaggccgttccaacactgcgcacccttgtcctcggtggtgaagcacccactcaggacaacgtgcaaacctggtccgataagttgaacctagttatcatttggggaccagccgaaaccaccatctacgcatcggctaccccgcccacgactcggcaaacaagtgcacaaggcctcggaaacccaatgggtagtgtaatgtggctgtgcgatccagacaaccacaataggctggtgccccttggttgcgtgggtgagattgttgtcgagggcccgctcgtctcgcgtggctatctgaaggacgaggcaaagacagcagctgcgtacatcgaggatccagtctgggctaagaagctggacaagagtgcctcacctcgccggatgtacaaaactggagatttggcacgctacgacgccaacggatatatgttattctccggtcgtaaagacaatcaggtgaagctccacggacaaagaatggagctggacgaagtggaacacgccatgttaagacacgaaagagtgcgccaggctgtcgcgcgtatccctcggcacggaccactcaaagacaagctggtggcgatgttgagtctccatgatgtctcatcgaccaactcccccgttgcaaacacaattattgtgcttgatgaagactgccatggtattaaggttggacaggaacttgcctccgtgcgtgagttgctgcaaaagaacctaccaagctacatggtaccaacaatttggattggtgttgaggctgttccgctgagcgccaattccaaggttgatcggaaatccgttgatgcttggatggaagagatggatcaggaaacctatgcctcgttgctgcgcgatggaggtagtgataagaaagaagaagaaattcgccgcccatccaccccggtggagcaaattctgtgcaacctcatcagcaagatccttggcttgagctcggagacactcaacctcaactcttcgttcctggcccttggtggcgactccgtcgctgccatgcagttgcgtagcaagtctcgcgctgagggggttacggtctccatgctggacattatcaggagcaagagtctcgtcgagcttgcgtcgaaggcggaatataccgaaccaactgtgaagaaggtccaggacgggtcctttgatctctcgccaatccagcagatgtacttcgatctggtgggatctgctgccgacgcaaacattggtcatttcgaccagagcattcttctggaagtcaacagcgacgtggcgcctcaaacattgcgacaggccctcgcacaggttgttcggcggcactcgatgctccgcgcccgatacgctcgaaacgatgccggccagtggtatcagtaccttgctgaagattcagcaaattcattccatttcagcgtcgaagatgtggaagatggttatcaagtgtccagaatactgaggaacatgggtggtgtgtttgacatcgaaaagggcccagtcttcgctgcccgcgtatataatcttcgatcagagcgcaaacagttgatgtttgttcatgctcatcatttggtggtggatgtggtttcgtggcacgttctgctcggcgatctggagcttgccattgccactggcagcttggccggcccagctccgctctctttccagagttggttgcgatctcaaaaggacatggcgcagtctcttgaaccacgagacctgctacccttctcaaacacaagcatgcctgtggccaactttgaatattggggaatgggaggcaacaagtcgaacagatactgcgacgccgttgttactgacttttggctcgatgagtccctaacgacccagttaatgagtgtcagcaaggggacttcaaacgccgcccctgtcgacatcattctggcttctcttctccactcctttgcggctgtcttccctgaccgtgccgcaccaccagtcttctctgagggccatggtcgcgagtcatggaacaaccaggtcgatccttccggcacagtgggttggtttacaactatgagcccactgcatgtatctgatctgcaattggatattatcaagaccgtgcagaccgtaaaggatctccgccgccggctaccggctaacggcatgtcatacttcagctccaggtatctctccgacaaagggcgcaaagcctttggttctcatttcgatatggagatcatgttcaactaccttggccggtcctctgaagttggaagtgagaacgcccttctctcgcatgccgaactaccagacggcgcgaccttcgaccaattggtccaagatgaaaagcttccccgctggtctctcttcgacatcgttgcccttgttgttggcggcagaacccacgttaccatggcctacaacaagcacatgcaacaccaggatagaatcgttgagtgggcagccaagacaaagtccacgcttagccttgccattgaggttctcagtggggtgaaaagcctgccgctcactccgccaactcccaaaccctcacccgtgcagcaccagcccaaggatcaaagcatcaccctcgacagcattgaaggaatttacccctgtgccccagtacagcgtcacatgctcgcagagcgcgaaaagcaccccaaccgccgcttgtacgaaatggattttacttaccaagctcatgcactcaatggtgtcgtcgacgtggatagaatccgcgaagcatggcaccaggttatacaacgccatcccgcacttcgaactgtcttccttcccagcatgtcttcacccggctcctacgatcaagttatcattcggaactggcaccccgaggtccccatgatcgagtgcgccagtgaggaggagatgacggcgcgcatggacgcctaccgatcggtcaactacagcctctcgaacagaaagccacaccatcagctcaccttgttcagtacaacagtcaatggcgtgcaaaagattgccttcaaaaccgaaacagaccacacccttaccgacggcgtttctgtcgctctgatcctccgcgacctgatgctggcgtatgagggcaagcttcccgccaccccagccccgtcattcggtagctattctgtctggctgaacgggatgagccaaggcgagacactagttaaggacaaggaatactggctagagttcgcgcggagctccgggccatcacttattcctcataccgatgcctccacccttgtactatcccaaccccgggtccacaaaacaaagaccatcaacctggattcggaaaccaccagccgactccccgccttctgtgttcagcacggtgtgacaatggcggcgttccttcagacggcctggggaatggtgttacagcacctcacgggatctgacaaaactctcttctccttcatgaccgccaacagagatgcgccgttcgccggcgcagcagagaccgtcggtccgctcatccaaatgcttctgtgtcggatcgatctcagcaacaaggagattggcgacgtgttgaggcaagcacgagatgacttcctcgagtcgctggagcatcagtacggactggcccagatggaagacgtgtggcagaccccagcgtggaattctctgatgagtctacagtacatggactcgcgagtgggtcagaaggccacggagcggactgaactggaggttgagctgcgttcggcagaagatcccactgcgtgggacgtgtcgatcggtgtgcagatccatagtcggggagacggtgttactgaggtagatgcagagcttggctattggtctgatgtgctcacggatgaaagggcaggagatgtgaaggatttgtttgaagcttctgtgaagaagatgcttgatggatgttgatggatagcaatttgaattgctcactcgttgatgttaacaggcgggacctgttttttccttttgtgtgaagaaatctggatgttgcacaaggtcgatccttgatgagcatcacctgacagactgactactgtaccacttttccttgtgtctatatatatctgttctctcgttgttgtctactatgtcgcttatcatatgtgtctctcgttgattgtctattatattctcttatctatcacttatcgaaactgagttctatttcaaagctatgcccttatctcatgagtatccaccctgcctgcctcccttcgtagaaccaactatactctgaatgtacatatgagttcctgtggtctgtttattcttaaggggggttcgggttatatgggacacatagtaaggaaggagacaatcaggaagaacatcgacttcttcacaaatttattctcgacagaaatccattaaacccacttagtgatgccagtgtcattaattagatttctgcctacttaggaaggcaattacttaccccaagcacatacgaccacagggtgtggaaaacagggcctcccgtccgctcagccgtacttaagccacacgccgggaggttagtagttgggtgggtgaccaccagcgaatcccttctgttgtatgtttttctttttgcatttattatttattgcctttagaagatgtgtagatcataatagaggggataggtagggtgtacattacgccaaccgccgctaagcaacgcaacgctaaatgatagtatcgaccacaaacacgagaaaaatttatcacaaagtacactccgtcctcatgtccccgggataaaattccttgtatgtccattcctaagcatgtgagctaagcctagcccctgttgaattcccgtcgtgttcccaatcaactccaaagtctggatgatccattccttcgtggcaggttccgcacccgcacagtcgcctgcaacgaacaaaggccagagcaggcgaatcacggccgggaatgtcacctctccagatacaaagtgatatggaacgctagcgcagaggtcatctgtcatctgcttgatagtatctatcgagtcaaacacgatttgttggcattcagatgtcccctgtaggccccagaggcgtagacccattgatctgatcatctcatgtaagataatacgcgtttggcgataatgattccacattgagactaccccgacggctttgtacatatggtaggtgtcgctgtgaaggggaatgtgggggcgagatttaggattactgtgtgtgtcaacgacggagtattgccaatgcggaccgagtgacatggcccaggcccgcagatccgtgtcaagatggagcgccttgctgataagtatgctcagagtgccaattgaatcatcgaccacggctgcgtcgtccacttcgacggagagatcatgtagttccatcagtatatcatagaatacctcaattggttgggaattcctgtccttctttgcttgtgccagcttcgtaagggccgttatcttggctgatttgtacctccgagatcttataaagacgccactaattgcctgataaatatagatgaggatgagagccaatacttgagtggagcaatactcacattttgcaaacggactaatgtaaacaactcgagtccagtttccgagttcaattgctccatgccgcgtagttcaacaagctttgtcgctcctcggacatgctgcgaccagccctgcattagacccgagcacgcgttccactgacccctcaattagaaagccgagcctgcaatcaaaggagctaatcttacctcgtacatgccaagcaagataacagccccaagagtggagtcagatttcgccgatactgggtctcgtagtgcgttattagtggcaatcagggccctgccgtactcttcccctgccgcacgctttagttcgggacgccggttgattctcgccatgctctccagccctgcagctttaatcgtgg

SEQ ID NO: 8 - DNA, 16269 bp, Aspergillus niger
atgtttactcaagccacttctactacccttgtcgagaacgtcggcgtctcccatcgcgagaaccccgacaccgagattgccgctctgatcaacgctgcctggagcatcgtggtctggcagtataccggacaggaagacactcgcttcatcaccgccactacatcgggagaggccgacgatcttgaatccacctaccaagtatgcaacgcacagctcgacggcgcaacaacaatctccgacttcatccaacaaacaccccaagcgacaaaggagctggcctccgaccaggtccctttggccccctcacgaaatgaggccgctacctcgccattcctgcaatcgattacgaccctcacctccaacaagacctatctcaactcctcctctcccagccatctggatgctacgggcgcactaatcgagctcgtggctattcctctgccatttggcaagctcgaatttgtggtgcgttttgcgccatctaccatcgaccaagaacgagccgatcacctcgcggctgcttttgcgcacgttcttaatttgatcaatgaccccgaccggcgacacgaccgcctagatgccatcgatctagtcagtaactacgataaggcaaagctttggacctggaatagcgtccagctgccggagacggtcgaatcatgcgtccatttcctcttccgccagcgcgcgcaggaggaaccggacatgctcgctgtggacgcctgggacggccgcttcacgtatggcgagctggacgatatttccgatcgcatcgcagtctggctagcccgagaagagggcatccgaccggaatccattgtacccctgtgctttgagaagagccgctgggccatcgccgccctgttgggtgtgatcaaagcaggtggtgctattgtgtttattgacccagctaacccagtcagccgcaggcaagatatcatggatcagatcgaaggtaagtgggtactgagctcgaaaagccaggccgaaacatgggaaaacgaaatgggcgtgcgaaccatcgtcttagacgagcaatttgccgcctccctgccggtcgaggatcatatcctcgagtccggcgttacccctaacaacctcctctaccttatttttacttcaggaagcacaggtaagccgaaaggctgcctcatcccgcacaaggcattcatctcaggtgcccttgtacacgcctctctatccaatctctcccgcggtagtcgtgtcttgcagctcgcctcgtacagtttcgatgtgagcatgttggagatcatgacttcccttatctcgggtgcatgtgtatgcaccccagacatggcgagcatggcccagggtctccagcccatcttcgacaaattcgacatcacatgggccttcttgacgccgtcgctagtcaagctgctgcgacctgagatggttcccaacctcaagacgctcgccctaggtggtgagccactcagcaaagtcgacatcgagacatgggcaccacacttgcaactaatcaacggatacggtccatccgagtgttccgtcgccgcggcgggcgatccacatctaaaaccgacgagtgatccatcaaatatcggccgcgccgttggcggcctttgctggatcgtggatgccgaaaatcacgaccggctcgtcccccttggcgccgtcggcgagctattgatctccggccccattctcgcacggggatatttgaatgatgcggaaaagacggccgcctccttcattgagaacccgacctggaccgaaggctggtcgctgacaccatcagacgcgaccgtctcaagtgaaagcgcatccatgcgcttctacaagaccggcgacttggcccggttcaaccttgacggcaccatccagatccttgggcgcaaagatacccaagtcaaacttcgtggattacgtgtggagttgggcgaaattgagcacaacatcgctcgccacccccacatcaaacatgctgcggcgttcctccccaagactgggcggtgtaaggagaaaattgtcgccgttgtatgtctcaaagacttcgctcaggactccaaatctggtcgatctgatgcgcccatcaacgtgctgtttgaagatgagaggccagatgttaaggatcaggccgatgccgttcggaaccacctgcgcgaatgtgtgccggaatacatggttcccgccgtctggatcgtgatcgaggcatggccgctattggtgtcggccaagctcgatcgcaagcgggtctttaactggttgttggatatggatgagggcctgtacaatcaccttttgggtttgctcggtactgacgtgtcagaaaacggctcttcggatgagaagtctgacgcccatctgtccgaggttgaacgaacccttcgcgacatctttgctcatgccttgaacactcccgctcacggtttgccgctggacaaatctttcattgcgcttggtggcgacagtctcgctgccatgcgtgtgatctcacaatgccagcgtgccgggttgaatgtgacagtcccggacatgatgaagagtaaatgcatcaaggacctggctgcccgtgtggagaagacccctgggatgaaaacaaagccagatcttttggatgtctcatttccactttcgcgggctcagcagttctgtctgggtgacgggagagcggcaaaccatctcacgcagagcattcttctgaaactggatagcactgtttcggccgctcgtgtcaaggctgcgttggaagccattgtcacccgccactccatgttgcgggcgcgctttggtgaatcagaaggaaatggcgccctgtctctcagacagacggtcacctctgagatcgagggttcttacagctttcagcatcaccgcatagaacgtcctgaagatatcaccaccatcgcagccacagcagacgccgtgtccctctctgggccaattttctccgctggtctagttacaggagcggaaaagcaactattggtcttgagagcccacagtgctgtggtcgacggtgcctcctggagcatcatcatccggcagctccagacctgcttgagtctcccagatgggcctcttctgggcgaagaggcccaggagccagtctctttccagaactgggtcagcgtcgagagagagacaacgggtgacgagattgcagtcgcgccacgcattctgctagcatcggaggttgacatggactaccaggcagtggagcttgaccaggcaacaactaccctgctcttgagcgaggaagtacacaagccactgcggactcacgtcgtcgacttcatgatggcaagtctgatgctttcatttaggcaaacatttggcggccgggagaccctacctacacttgctttgtgggaggatgagcgtggacgcgcgtctgaagattttggcattgacctctcgcaaaccgttggtcgattcgagactctgcgtgcattgaatctcgacacggccgatatgagcaccaacgacgcgcaagtgcgcatgttgaaggggatcaaggacgcccggaaaacgacaatggagccaagcagtattcagaacccggagatctcgtttcgctaccgtgatctgtcgaacattattgacggtcctcgcagccttgtgcaaatcaaaccgcgtcccgtctttctccctgcgcccggagcagctcctttggttagcaacatctccattgtggcggaagtcatcgatgagaatattcagcttgccttctcttttaacaagaaggttgttcaagagaaccaggtcaaggcgtggattgcgaccgcgcaggaaacgcttgcttcccttgttgtcaagatggtcaacgccccggttgaatacaccccatcagacttcccgttattgcacggaatcagctacaacaccctggacaagctcatcaacgaacaactgccccagatcggccttattcctgggcctgagtcttcgttgatcgaagacatttatccatgctcacccatgcagcaggacctgttgcttagccagcaccggtccgcggatgacatgtatgatgtctaccatatcgcggaactgaggccacgcgatcccagggaccctgacgaagatttcgcgtccgtccttgccaaccaagaccccatctcgatcagaggacccgagcctgcgcatcggttgtctatctgccgcattgcaggagccagtcacgttgtcatcaaactagagatgaaccatgtcatcgtggatggcgtctctgcggctgtgattgtccgtgatctactgcaggcgtatgatgggcatgcggcgcaattggagcctgcaatgccgttccgccactacatctcccacatccgcgagacgcctctggaatcatcaatcgacttttgggcagattacctcaggggtcagagtgcgaccatggttcccaggctggccagcctagagacagagaaccaaggtgagagacagttgaacgtggtgtcagttcccctgaaagaggagggcgtctcaaatgaggcgcttctcgacttctgccggagggcctccgtcacccctgccaatgtgtttcaggctgcctgggcactggtactccgggcttatgccgagtcgcccgagcaagtctgcttcggttacctctcagcaggacgcgacgctcccctcccaggcatccaagaaggagtcggtgctttcctcactatgctggtgagccgtctgtcttttgcaaccgaggagaaggagaacgaaggtgataagactgccaccgttactacattgctggacgcagtgcacattgttgccgaagactacgtcaacgccctgcctcaccagcacgttggtctctccaacatccagcacgcactccagacaggaggcagtccactcttcaataccatcattgcagtaaaccgtgatgttgacagcccagctgattcgtcactcatcttcaagaacatcggggatcacgaacccgatgagtacgccatcgtcctagacgtgcagctcaacggctctaacacggcgcgtgcttcactccgtcactggaccgatcacttgacggccaagcaagcaggcaatattgcgagtgcgctcggaaatgccgttcaagcaattataacccgcccggatacccctatcagcgaggttgaacttgtgggcgtcgcccatacggatcaactgttgtccttcaacacccaccaactgccacgggcaaaccgattgatcttcacgaatttcgagaagctcgcccgcgtgcagcctcacgctccggcggtgtgtgcttgggatggcgagtggacatacagccagctcgatgaggtatccaaccgcctcgctcactacctgcgtaccttaggggtaggtcccgaggccgttgtgccacactgtttcccgaagtcgggttggaccatcgtgacgtgccttgcgattctgaaagccggtggtgccttcgtcgggctggatccgacccatccaaaaaagcgactggagggtttggtccaagaagccggagccaaggtggtgtgtgtggcaccgcagaatcgggacttgttcgaagggtgcgacaacttgagcattgtggagatcacgccagagttcgttgctaagctcccttcaaagtctggcccggcatgcggctacatccagccaaacaatgcggcttgcgtcgttttcacgtctggtacgaccggtcggcccaaggctgtagtggtggaacatgcctcgatggcgaccctgtcagatctcatgggtccggcggttcgtatcggtccagaggctcgcgtcttccagttcgccagttacacctttgatacatcgaatcaggacattttcaccaccctccagcgcggtggctgcgtttgcgtgccgtcagatgaggaccgtgtcaacgatatccctggagcattgaaccgccttcgcgctaaccacgcccacttgaccagcactgttattagtctcatgcgcccggagcaggtcccccagctccgatggctgtttagcgctggcgagccccttacccgggagaacgtggagatctgggcgccagcagtcgagctttacaacagttatggcccggccgagtcatctgtcgccgtcacttgtactcccacccgtctgagcccgagtggcagcccagcaaacatcggtcaggcctttggttgccacgcatggatcgcggatcccaccgactaccacaagctgatgcctctgggtgccgtgggagagctccttcttgagggtccgctgctcgcgcgtcactacctgaacaacccagaacagacagcagcagcctttgtccagaacccccgatgggcgaagagtatgagtccggaccagaaccggcgattctaccgaaccggcgatctgtgtcgcttcaaccgtgacggcagtctgaccatcatcggccgccgtgatagccagatcaagattcacggccagcgcgttgagcttgaccacatcaagtacgaagttcaggcccagctcgcccagcttgatcaatcgagtctggtttccgttgatgctgtgatgcttccaaaggcccaaatccaggaccgaactttggtagcattcgttcagtttctcgacgaggcgcctgcgaagcccctggacactttgtccattcccatgactgagaggctcgcccgcctgttctccgacctgcagcgagccctcaagtcaagcctacctcaatacatggtcccggccatgttcgtcccaatcacgcagattccacgaaccgcgaacggcaagctggctcgtaatgtcctgcgggagataatcgctggtctttccgaggccgacgtttctcgttacatgctgcagggtgagaccgcgaagaaagccccgacgacaccccgtgagcagaagcttcaagccgcctggagtaaagtcctgaacttgcccttggagaaggtgggcgcttctgatgacttcttccaacttggaggcgactcagttgtggccatgcggcttgcaggcgctgcacgagtggcaggcatgtccttgactttcgcggacatcttcgcgaatcccgtcttgtccgacatggctcaagttgtacgaatgggcgatgaatctggagaacaggagacagatgagaaagcatttgaccttgtcccactgtcatccacgtcatcactgcagacgattcgcgccgaagcggcaacacagtgtggtgtcaggcctgatgccatcgttgatatgtacccatccaccccactacaggagggtctggtcgctctttcgatgcgacaaaccggagcgtacaaggatcagcgcatcctgcgcctcacagacccaaattacgacgtgtccagattccgccgtgcgttcgatgccgttgtctccgccgaacctattttccgaacgcgctttgtgagcgtcagtggcgccggactcctccaggcggtactgaatgtcccggttgactggatcaagcgcgacaatctggccgcgtatctcgaggaggatttgaacgctccggtgacgtatggaagtgcgctcatccgtctcgccatggtagaggagaacggagaacgttacattgtgtggtcaggacaccatgcactttgcgacggcttcagcatggacatcacattcgaacagattgcccacgcgatggcacacgagggttccgtggtctccaagccggtctccttcaagggattcatccgcttcttgcaggatcaggatcgagacagctctgccagggagtactggcagaagcagttccctgctgacggcgaggcaccgccccaatttccacccaggccacaaggccaccaggttgtccctcatcgtgcttgtcgcctacaattccagctgaatcgcccggctggtaccaagatctcagtgacgaactatctgcgcgccgcatggggtctcgtcgtggctcgacaccaggacagctcggacgtcctgttcggcgtgaccctttctggccgaaacgccccggttgcaggtatctctaccatgaacgggcccacgatgacaaccgccccgttccgtatgaccgtcccgttggatagcgatacaacggtagctcagtatcttgacgccctccaccaacaggccattacaatgatgccgtttgaacacaccggtctgcagaatattcgtcgtctcaatgagctggcccgtgcggctgtggacaatatgggacatcgttttgcggtggagcctagcatcagcgacgtcagtgaggcccttgacggcatggaaattgtatccgccgatcttccagagggcttttacaccgatgccttggtcattcgcaactatgaccacagtgatggagcaatcgtcgtggaagctcgctatgatcacaccttgatctctgaccgcgatatgcagagactgcttagccaatacaatcatgtggtccagcaactgaccagtcaaccggagacgtgcattcgtgatatccaagtgcttagccccgacgacatcagtgagatcatgtcatggaatggtgatctacctgaaacggttcaagggtgcgtgcatcaacttgtcgcagagcgagcgaaggagcgtccagacgctgaggccgtgtgtgcctgggacggaagttacaccttcggggaattggatggggtgaccgaacgcctcgcagcccatcttcagaacctcggcgtcggcccagaagtgacggtcgctctttgctttgacaagtccaaatggaatgtcgtctctatgctatccatcctgaaggctggcggttgctacacggccttgagtccggcatacccagccgctcgcatgcaggatatcctccaggatgtccaagcacccctggtactgtgctcaccccatcatgcagataagttctctggcatggcgcccaaggttctgccaatcgacgatgccagtttcgaatatctacccaagcaaacaacaacccatcgcgtcacctccgcagtgcaaccatccaatgcagcactgatcgttttcacctccggcagtaccggtaagcccaagggcgcaatcattgaacatcgtggtttgtgttccatgcagcactatgaaggacctcatgtacaaatgggaccggatactcgcacactacaattcgcctctcatgtctttgacgtgtccaactcggaggtttttaccaccttgatgcggggtggctgtgtgtgtgtgccgtccgagaccgagcgacttagcgacctcgctggcgcagttaacaagtacagagtaaactggtccttccacgttccaacaactgcagagacgctcgatccggagcagatgccaggcttgaagcatctggctttgggcggtgaagccatcagtcaaggcctatgtgaccgctgggcatctcgtgtgacactactcaattcatatggaccctcagagtgcagtatctggaccagtgtctcgcatctgcagccagggacttcatctccgaacaacatcggtcgtggacttggctgccggacatggatcaccgaagcaaatgaccacaatcgtttggtggcgattgggtgcgtgggtgaactctgtgtggaaggcccaatcgtcacacgaggttataaagccaatcccgaacagaccgctgctgcttacatcgagaacccagcatttgcgcggactctaggcatccaagccatgcgcatctataagacaggtgacttggtaaagtatgatgcagacggcaatatcctctatgtcggccgtaaggatagccaagtcaaggtccgtggacagcgcattgaactgagcgaggtggaacaaaacatcgtggcccacggcattgatgcagacgctgtcgttgtcgaaaaggtcttcttgaatgggaacaaagaccgcgtggctctggcggccttcctaagactcaatgcatcctctgagtcgactggtgcatctggggatgtcgaaagcatggacgtcgttcgagaccagctcgtcgccctcaagaaccacttattggacaccattcctcctcacatggtcccctctttctttattcctctacgatccatgcctgtgacacagacgggaaagaagaaccgcaaggcgctcagaacactcggtgcatctttgtcgtccgagcaaagacaacagtacactctcgacgatgaagccgattcatcaaacaccaacggaggtcgcgcatgcactagcgaagctgagaagcggctccgagcattgtggtctgaagtcctcggaatcttcccagaggagtcaatctcggccagcgataatttcttccacagaggaggtgattcaattcaagccatgcgacttgcggccgcggctcgtcgcgctggcaaagcgctggcagtgagcgacttgttccgcatgccgcggctgtaccaaatggccgagctctgggagagcagtgtgcaaagccaagacgcaaccattgcgcctttctcgctgctccagccagagatcgttgacgacgctattcaggaggccgttcgccaatgcaatgtcgatgcgagcgacatcgaagacatttatctctgttcggcactgcaggaaggtctcatggcagtctccactcggaagcagggctcctacatctcgacaagaatcttcgacttgccagctgatctcgacattgatcgcttcaaggaagcatggcaaaaggccgccgacgtcttcccgatcttgcggacgcgcattatcctcggtcgtgcctccgagtctctccaggtcgtgctcaaggaaaagctagcatggcagaccatcaccgatgagacatcctttagccttcccgtcattgagtacggaggccgtctgtgctcctttgcgatcgacgtcgaggcacgcaaatttgtcttggccctccatcacgctctttatgatggctggagtgccacggtactgcttggggctgtggaaaagttctacgcgggtgagcaataccaggtgggtccaggatataatgtcttcattcggcatctctctcaagttgatcaatccgagtcggacaatttctggaaaggtcagctcagtggtacacccgcacatttccccaagttgccctccaaaacatacgaggccaagaacagcgccaacgtctctcacaccatccgtctaccagcgcccgagcatcaacccactggaatactcaagtcaaccttgctccgagcagcatgggctatcgtgagttccaggcatgccgggtccaatgatatcacctttggtgcagcccaatcaggtcgcgactgcgctgtccctggcatcgtggaagttgtcggcccaactgttacgacggtaccggttcgcatccagatcaatgacgacgagaccatcgtcaacttcctccagcgggttcaagagcaatctgtcagcatgatcccgcaccagcatgccggtgtgcaaacacttcgacagctgggcaaagacgtccaacccgcgctcgacttcaccactttgttcgagttcggagaggattccaaccagagtggcttcatcactgagatagaaatgcctgagctgctggacggtttctggtcctatcctattgtcttcgagtgccatctggctcagagcggggagactgtcaacgttttggcacgacatgacccgacggtcattcccacacaccagatggattggatctgcaagcagttcgaacacgtcgtcgaccagctctaccgtatggcatctgatgggctcgaggctagaaaggttggtgagctcgacctcttcggcccaagtgactttacccaaatcgaggcctggaatgctagatggcctgtgggttccatcgacggcaaggcagttcacgaggccattgccgagcaatgccgacttcatccccagaacctcgccctctcaggctgggatggcgaaatgacctacgcccagctagagcactacgcgacaaagttagccaaggcacttgttctaaagggtgttggactcgaagtcatggttccactctgctttgacaagtccacctgggcgatcgtgtctaccatagctatcatcaaagccggaggcgtcgttgtgcatcttgggcctactcacccggcgaaccgcagaaaggagatcttgaaaacgatcggagccgagtttgtattggtctcgccgcaacacactggcatctttgatgatgcggctgtcacaaccatcccaattgaccgagagtatttggatcggctgcccgatgttgactacgtggaactgcccaaggtcaagccctccaacgcagtctatgtttgcttcacttcaggaagcacgggtcggccgaagggaattgtggtcgaacacggcaatctgcgcatgagcgcccaggcacatggtgctcaattcaaggtcaaccctggcaccagggtgttccagttctcggcttatactttcgatatcggtctcggtgacatattcatttccctccaacgcggagccaccatctgcacgccatctgagtgggagaggttgaacgagctttctggagccatcaccaaatataaggcaaacttcatgtcggtcaccccatcggtggccaaacttctccgcccagaggccgttccaacactgcgcacccttgtcctcggtggtgaagcacccactcaggacaacgtgcaaacctggtccgataagttgaacctagttatcatttggggaccagccgaaaccaccatctacgcatcggctaccccgcccacgactcggcaaacaagtgcacaaggcctcggaaacccaatgggtagtgtaatgtggctgtgcgatccagacaaccacaataggctggtgccccttggttgcgtgggtgagattgttgtcgagggcccgctcgtctcgcgtggctatctgaaggacgaggcaaagacagcagctgcgtacatcgaggatccagtctgggctaagaagctggacaagagtgcctcacctcgccggatgtacaaaactggagatttggcacgctacgacgccaacggatatatgttattctccggtcgtaaagacaatcaggtgaagctccacggacaaagaatggagctggacgaagtggaacacgccatgttaagacacgaaagagtgcgccaggctgtcgcgcgtatccctcggcacggaccactcaaagacaagctggtggcgatgttgagtctccatgatgtctcatcgaccaactcccccgttgcaaacacaattattgtgcttgatgaagactgccatggtattaaggttggacaggaacttgcctccgtgcgtgagttgctgcaaaagaacctaccaagctacatggtaccaacaatttggattggtgttgaggctgttccgctgagcgccaattccaaggttgatcggaaatccgttgatgcttggatggaagagatggatcaggaaacctatgcctcgttgctgcgcgatggaggtagtgataagaaagaagaagaaattcgccgcccatccaccccggtggagcaaattctgtgcaacctcatcagcaagatccttggcttgagctcggagacactcaacctcaactcttcgttcctggcccttggtggcgactccgtcgctgccatgcagttgcgtagcaagtctcgcgctgagggggttacggtctccatgctggacattatcaggagcaagagtctcgtcgagcttgcgtcgaaggcggaatataccgaaccaactgtgaagaaggtccaggacgggtcctttgatctctcgccaatccagcagatgtacttcgatctggtgggatctgctgccgacgcaaacattggtcatttcgaccagagcattcttctggaagtcaacagcgacgtggcgcctcaaacattgcgacaggccctcgcacaggttgttcggcggcactcgatgctccgcgcccgatacgctcgaaacgatgccggccagtggtatcagtaccttgctgaagattcagcaaattcattccatttcagcgtcgaagatgtggaagatggttatcaagtgtccagaatactgaggaacatgggtggtgtgtttgacatcgaaaagggcccagtcttcgctgcccgcgtatataatcttcgatcagagcgcaaacagttgatgtttgttcatgctcatcatttggtggtggatgtggtttcgtggcacgttctgctcggcgatctggagcttgccattgccactggcagcttggccggcccagctccgctctctttccagagttggttgcgatctcaaaaggacatggcgcagtctcttgaaccacgagacctgctacccttctcaaacacaagcatgcctgtggccaactttgaatattggggaatgggaggcaacaagtcgaacagatactgcgacgccgttgttactgacttttggctcgatgagtccctaacgacccagttaatgagtgtcagcaaggggacttcaaacgccgcccctgtcgacatcattctggcttctcttctccactcctttgcggctgtcttccctgaccgtgccgcaccaccagtcttctctgagggccatggtcgcgagtcatggaacaaccaggtcgatccttccggcacagtgggttggtttacaactatgagcccactgcatgtatctgatctgcaattggatattatcaagaccgtgcagaccgtaaaggatctccgccgccggctaccggctaacggcatgtcatacttcagctccaggtatctctccgacaaagggcgcaaagcctttggttctcatttcgatatggagatcatgttcaactaccttggccggtcctctgaagttggaagtgagaacgcccttctctcgcatgccgaactaccagacggcgcgaccttcgaccaattggtccaagatgaaaagcttccccgctggtctctcttcgacatcgttgcccttgttgttggcggcagaacccacgttaccatggcctacaacaagcacatgcaacaccaggatagaatcgttgagtgggcagccaagacaaagtccacgcttagccttgccattgaggttctcagtggggtgaaaagcctgccgctcactccgccaactcccaaaccctcacccgtgcagcaccagcccaaggatcaaagcatcaccctcgacagcattgaaggaatttacccctgtgccccagtacagcgtcacatgctcgcagagcgcgaaaagcaccccaaccgccgcttgtacgaaatggattttacttaccaagctcatgcactcaatggtgtcgtcgacgtggatagaatccgcgaagcatggcaccaggttatacaacgccatcccgcacttcgaactgtcttccttcccagcatgtcttcacccggctcctacgatcaagttatcattcggaactggcaccccgaggtccccatgatcgagtgcgccagtgaggaggagatgacggcgcgcatggacgcctaccgatcggtcaactacagcctctcgaacagaaagccacaccatcagctcaccttgttcagtacaacagtcaatggcgtgcaaaagattgccttcaaaaccgaaacagaccacacccttaccgacggcgtttctgtcgctctgatcctccgcgacctgatgctggcgtatgagggcaagcttcccgccaccccagccccgtcattcggtagctattctgtctggctgaacgggatgagccaaggcgagacactagttaaggacaaggaatactggctagagttcgcgcggagctccgggccatcacttattcctcataccgatgcctccacccttgtactatcccaaccccgggtccacaaaacaaagaccatcaacctggattcggaaaccaccagccgactccccgccttctgtgttcagcacggtgtgacaatggcggcgttccttcagacggcctggggaatggtgttacagcacctcacgggatctgacaaaactctcttctccttcatgaccgccaacagagatgcgccgttcgccggcgcagcagagaccgtcggtccgctcatccaaatgcttctgtgtcggatcgatctcagcaacaaggagattggcgacgtgttgaggcaagcacgagatgacttcctcgagtcgctggagcatcagtacggactggcccagatggaagacgtgtggcagaccccagcgtggaattctctgatgagtctacagtacatggactcgcgagtgggtcagaaggccacggagcggactgaactggaggttgagctgcgttcggcagaagatcccactgcgtgggacgtgtcgatcggtgtgcagatccatagtcggggagacggtgttactgaggtagatgcagagcttggctattggtctgatgtgctcacggatgaaagggcaggagatgtgaaggatttgtttgaagcttctgtgaagaagatgcttgatggatgttga

SEQ ID NO: 9 - RNA, 16269 nt, Aspergillus niger
auguuuacucaagccacuucuacuacccuugucgagaacgucggcgucucccaucgcgagaaccccgacaccgagauugccgcucugaucaacgcugccuggagcaucguggucuggcaguauaccggacaggaagacacucgcuucaucaccgccacuacaucgggagaggccgacgaucuugaauccaccuaccaaguaugcaacgcacagcucgacggcgcaacaacaaucuccgacuucauccaacaaacaccccaagcgacaaaggagcuggccuccgaccaggucccuuuggcccccucacgaaaugaggccgcuaccucgccauuccugcaaucgauuacgacccucaccuccaacaagaccuaucucaacuccuccucucccagccaucuggaugcuacgggcgcacuaaucgagcucguggcuauuccucugccauuuggcaagcucgaauuuguggugcguuuugcgccaucuaccaucgaccaagaacgagccgaucaccucgcggcugcuuuugcgcacguucuuaauuugaucaaugaccccgaccggcgacacgaccgccuagaugccaucgaucuagucaguaacuacgauaaggcaaagcuuuggaccuggaauagcguccagcugccggagacggucgaaucaugcguccauuuccucuuccgccagcgcgcgcaggaggaaccggacaugcucgcuguggacgccugggacggccgcuucacguauggcgagcuggacgauauuuccgaucgcaucgcagucuggcuagcccgagaagagggcauccgaccggaauccauuguaccccugugcuuugagaagagccgcugggccaucgccgcccuguugggugugaucaaagcagguggugcuauuguguuuauugacccagcuaacccagucagccgcaggcaagauaucauggaucagaucgaagguaaguggguacugagcucgaaaagccaggccgaaacaugggaaaacgaaaugggcgugcgaaccaucgucuuagacgagcaauuugccgccucccugccggucgaggaucauauccucgaguccggcguuaccccuaacaaccuccucuaccuuauuuuuacuucaggaagcacagguaagccgaaaggcugccucaucccgcacaaggcauucaucucaggugcccuuguacacgccucucuauccaaucucucccgcgguagucgugucuugcagcucgccucguacaguuucgaugugagcauguuggagaucaugacuucccuuaucucgggugcauguguaugcaccccagacauggcgagcauggcccagggucuccagcccaucuucgacaaauucgacaucacaugggccuucuugacgccgucgcuagucaagcugcugcgaccugagaugguucccaaccucaagacgcucgcccuagguggugagccacucagcaaagucgacaucgagacaugggcaccacacuugcaacuaaucaacggauacgguccauccgaguguuccgucgccgcggcgggcgauccacaucuaaaaccgacgagugauccaucaaauaucggccgcgccguuggcggccuuugcuggaucguggaugccgaaaaucacgaccggcucgucccccuuggcgccgucggcgagcuauugaucuccggccccauucucgcacggggauauuugaaugaugcggaaaagacggccgccuccuucauugagaacccgaccuggaccgaaggcuggucgcugacaccaucagacgcgaccgucucaagugaaagcgcauccaugcgcuucuacaagaccggcgacuuggcccgguucaaccuugacggcaccauccagauccuugggcgcaaagauacccaagucaaacuucguggauuacguguggaguugggcgaaauugagcacaacaucgcucgccacccccacaucaaacaugcugcggcguuccuccccaagacugggcgguguaaggagaaaauugucgccguuguaugucucaaagacuucgcucaggacuccaaaucuggucgaucugaugcgcccaucaacgugcuguuugaagaugagaggccagauguuaaggaucaggccgaugccguucggaaccaccugcgcgaaugugugccggaauacaugguucccgccgucuggaucgugaucgaggcauggccgcuauuggugucggccaagcucgaucgcaagcgggucuuuaacugguuguuggauauggaugagggccuguacaaucaccuuuuggguuugcucgguacugacgugucagaaaacggcucuucggaugagaagucugacgcccaucuguccgagguugaacgaacccuucgcgacaucuuugcucaugccuugaacacucccgcucacgguuugccgcuggacaaaucuuucauugcgcuugguggcgacagucucgcugccaugcgugugaucucacaaugccagcgugccggguugaaugugacagucccggacaugaugaagaguaaaugcaucaaggaccuggcugcccguguggagaagaccccugggaugaaaacaaagccagaucuuuuggaugucucauuuccacuuucgcgggcucagcaguucugucugggugacgggagagcggcaaaccaucucacgcagagcauucuucugaaacuggauagcacuguuucggccgcucgugucaaggcugcguuggaagccauugucacccgccacuccauguugcgggcgcgcuuuggugaaucagaaggaaauggcgcccugucucucagacagacggucaccucugagaucgaggguucuuacagcuuucagcaucaccgcauagaacguccugaagauaucaccaccaucgcagccacagcagacgccgugucccucucugggccaauuuucuccgcuggucuaguuacaggagcggaaaagcaacuauuggucuugagagcccacagugcuguggucgacggugccuccuggagcaucaucauccggcagcuccagaccugcuugagucucccagaugggccucuucugggcgaagaggcccaggagccagucucuuuccagaacugggucagcgucgagagagagacaacgggugacgagauugcagucgcgccacgcauucugcuagcaucggagguugacauggacuaccaggcaguggagcuugaccaggcaacaacuacccugcucuugagcgaggaaguacacaagccacugcggacucacgucgucgacuucaugauggcaagucugaugcuuucauuuaggcaaacauuuggcggccgggagacccuaccuacacuugcuuugugggaggaugagcguggacgcgcgucugaagauuuuggcauugaccucucgcaaaccguuggucgauucgagacucugcgugcauugaaucucgacacggccgauaugagcaccaacgacgcgcaagugcgcauguugaaggggaucaaggacgcccggaaaacgacaauggagccaagcaguauucagaacccggagaucucguuucgcuaccgugaucugucgaacauuauugacgguccucgcagccuugugcaaaucaaaccgcgucccgucuuucucccugcgcccggagcagcuccuuugguuagcaacaucuccauuguggcggaagucaucgaugagaauauucagcuugccuucucuuuuaacaagaagguuguucaagagaaccaggucaaggcguggauugcgaccgcgcaggaaacgcuugcuucccuuguugucaagauggucaacgccccgguugaauacaccccaucagacuucccguuauugcacggaaucagcuacaacacccuggacaagcucaucaacgaacaacugccccagaucggccuuauuccugggccugagucuucguugaucgaagacauuuauccaugcucacccaugcagcaggaccuguugcuuagccagcaccgguccgcggaugacauguaugaugucuaccauaucgcggaacugaggccacgcgaucccagggacccugacgaagauuucgcguccguccuugccaaccaagaccccaucucgaucagaggacccgagccugcgcaucgguugucuaucugccgcauugcaggagccagucacguugucaucaaacuagagaugaaccaugucaucguggauggcgucucugcggcugugauuguccgugaucuacugcaggcguaugaugggcaugcggcgcaauuggagccugcaaugccguuccgccacuacaucucccacauccgcgagacgccucuggaaucaucaaucgacuuuugggcagauuaccucaggggucagagugcgaccaugguucccaggcuggccagccuagagacagagaaccaaggugagagacaguugaacguggugucaguuccccugaaagaggagggcgucucaaaugaggcgcuucucgacuucugccggagggccuccgucaccccugccaauguguuucaggcugccugggcacugguacuccgggcuuaugccgagucgcccgagcaagucugcuucgguuaccucucagcaggacgcgacgcuccccucccaggcauccaagaaggagucggugcuuuccucacuaugcuggugagccgucugucuuuugcaaccgaggagaaggagaacgaaggugauaagacugccaccguuacuacauugcuggacgcagugcacauuguugccgaagacuacgucaacgcccugccucaccagcacguuggucucuccaacauccagcacgcacuccagacaggaggcaguccacucuucaauaccaucauugcaguaaaccgugauguugacagcccagcugauucgucacucaucuucaagaacaucggggaucacgaacccgaugaguacgccaucguccuagacgugcagcucaacggcucuaacacggcgcgugcuucacuccgucacuggaccgaucacuugacggccaagcaagcaggcaauauugcgagugcgcucggaaaugccguucaagcaauuauaacccgcccggauaccccuaucagcgagguugaacuugugggcgucgcccauacggaucaacuguuguccuucaacacccaccaacugccacgggcaaaccgauugaucuucacgaauuucgagaagcucgcccgcgugcagccucacgcuccggcggugugugcuugggauggcgaguggacauacagccagcucgaugagguauccaaccgccucgcucacuaccugcguaccuuagggguaggucccgaggccguugugccacacuguuucccgaagucggguuggaccaucgugacgugccuugcgauucugaaagccgguggugccuucgucgggcuggauccgacccauccaaaaaagcgacuggaggguuugguccaagaagccggagccaaggugguguguguggcaccgcagaaucgggacuuguucgaagggugcgacaacuugagcauuguggagaucacgccagaguucguugcuaagcucccuucaaagucuggcccggcaugcggcuacauccagccaaacaaugcggcuugcgucguuuucacgucugguacgaccggucggcccaaggcuguagugguggaacaugccucgauggcgacccugucagaucucauggguccggcgguucguaucgguccagaggcucgcgucuuccaguucgccaguuacaccuuugauacaucgaaucaggacauuuucaccacccuccagcgcgguggcugcguuugcgugccgucagaugaggaccgugucaacgauaucccuggagcauugaaccgccuucgcgcuaaccacgcccacuugaccagcacuguuauuagucucaugcgcccggagcaggucccccagcuccgauggcuguuuagcgcuggcgagccccuuacccgggagaacguggagaucugggcgccagcagucgagcuuuacaacaguuauggcccggccgagucaucugucgccgucacuuguacucccacccgucugagcccgaguggcagcccagcaaacaucggucaggccuuugguugccacgcauggaucgcggaucccaccgacuaccacaagcugaugccucugggugccgugggagagcuccuucuugaggguccgcugcucgcgcgucacuaccugaacaacccagaacagacagcagcagccuuuguccagaacccccgaugggcgaagaguaugaguccggaccagaaccggcgauucuaccgaaccggcgaucugugucgcuucaaccgugacggcagucugaccaucaucggccgccgugauagccagaucaagauucacggccagcgcguugagcuugaccacaucaaguacgaaguucaggcccagcucgcccagcuugaucaaucgagucugguuuccguugaugcugugaugcuuccaaaggcccaaauccaggaccgaacuuugguagcauucguucaguuucucgacgaggcgccugcgaagccccuggacacuuuguccauucccaugacugagaggcucgcccgccuguucuccgaccugcagcgagcccucaagucaagccuaccucaauacauggucccggccauguucgucccaaucacgcagauuccacgaaccgcgaacggcaagcuggcucguaauguccugcgggagauaaucgcuggucuuuccgaggccgacguuucucguuacaugcugcagggugagaccgcgaagaaagccccgacgacaccccgugagcagaagcuucaagccgccuggaguaaaguccugaacuugcccuuggagaaggugggcgcuucugaugacuucuuccaacuuggaggcgacucaguuguggccaugcggcuugcaggcgcugcacgaguggcaggcauguccuugacuuucgcggacaucuucgcgaaucccgucuuguccgacauggcucaaguuguacgaaugggcgaugaaucuggagaacaggagacagaugagaaagcauuugaccuugucccacugucauccacgucaucacugcagacgauucgcgccgaagcggcaacacaguguggugucaggccugaugccaucguugauauguacccauccaccccacuacaggagggucuggucgcucuuucgaugcgacaaaccggagcguacaaggaucagcgcauccugcgccucacagacccaaauuacgacguguccagauuccgccgugcguucgaugccguugucuccgccgaaccuauuuuccgaacgcgcuuugugagcgucaguggcgccggacuccuccaggcgguacugaaugucccgguugacuggaucaagcgcgacaaucuggccgcguaucucgaggaggauuugaacgcuccggugacguauggaagugcgcucauccgucucgccaugguagaggagaacggagaacguuacauuguguggucaggacaccaugcacuuugcgacggcuucagcauggacaucacauucgaacagauugcccacgcgauggcacacgaggguuccguggucuccaagccggucuccuucaagggauucauccgcuucuugcaggaucaggaucgagacagcucugccagggaguacuggcagaagcaguucccugcugacggcgaggcaccgccccaauuuccacccaggccacaaggccaccagguugucccucaucgugcuugucgccuacaauuccagcugaaucgcccggcugguaccaagaucucagugacgaacuaucugcgcgccgcauggggucucgucguggcucgacaccaggacagcucggacguccuguucggcgugacccuuucuggccgaaacgccccgguugcagguaucucuaccaugaacgggcccacgaugacaaccgccccguuccguaugaccgucccguuggauagcgauacaacgguagcucaguaucuugacgcccuccaccaacaggccauuacaaugaugccguuugaacacaccggucugcagaauauucgucgucucaaugagcuggcccgugcggcuguggacaauaugggacaucguuuugcgguggagccuagcaucagcgacgucagugaggcccuugacggcauggaaauuguauccgccgaucuuccagagggcuuuuacaccgaugccuuggucauucgcaacuaugaccacagugauggagcaaucgucguggaagcucgcuaugaucacaccuugaucucugaccgcgauaugcagagacugcuuagccaauacaaucaugugguccagcaacugaccagucaaccggagacgugcauucgugauauccaagugcuuagccccgacgacaucagugagaucaugucauggaauggugaucuaccugaaacgguucaagggugcgugcaucaacuugucgcagagcgagcgaaggagcguccagacgcugaggccgugugugccugggacggaaguuacaccuucggggaauuggauggggugaccgaacgccucgcagcccaucuucagaaccucggcgucggcccagaagugacggucgcucuuugcuuugacaaguccaaauggaaugucgucucuaugcuauccauccugaaggcuggcgguugcuacacggccuugaguccggcauacccagccgcucgcaugcaggauauccuccaggauguccaagcaccccugguacugugcucaccccaucaugcagauaaguucucuggcauggcgcccaagguucugccaaucgacgaugccaguuucgaauaucuacccaagcaaacaacaacccaucgcgucaccuccgcagugcaaccauccaaugcagcacugaucguuuucaccuccggcaguaccgguaagcccaagggcgcaaucauugaacaucgugguuuguguuccaugcagcacuaugaaggaccucauguacaaaugggaccggauacucgcacacuacaauucgccucucaugucuuugacguguccaacucggagguuuuuaccaccuugaugcgggguggcugugugugugugccguccgagaccgagcgacuuagcgaccucgcuggcgcaguuaacaaguacagaguaaacugguccuuccacguuccaacaacugcagagacgcucgauccggagcagaugccaggcuugaagcaucuggcuuugggcggugaagccaucagucaaggccuaugugaccgcugggcaucucgugugacacuacucaauucauauggacccucagagugcaguaucuggaccagugucucgcaucugcagccagggacuucaucuccgaacaacaucggucguggacuuggcugccggacauggaucaccgaagcaaaugaccacaaucguuugguggcgauugggugcgugggugaacucuguguggaaggcccaaucgucacacgagguuauaaagccaaucccgaacagaccgcugcugcuuacaucgagaacccagcauuugcgcggacucuaggcauccaagccaugcgcaucuauaagacaggugacuugguaaaguaugaugcagacggcaauauccucuaugucggccguaaggauagccaagucaagguccguggacagcgcauugaacugagcgagguggaacaaaacaucguggcccacggcauugaugcagacgcugucguugucgaaaaggucuucuugaaugggaacaaagaccgcguggcucuggcggccuuccuaagacucaaugcauccucugagucgacuggugcaucuggggaugucgaaagcauggacgucguucgagaccagcucgucgcccucaagaaccacuuauuggacaccauuccuccucacaugguccccucuuucuuuauuccucuacgauccaugccugugacacagacgggaaagaagaaccgcaaggcgcucagaacacucggugcaucuuugucguccgagcaaagacaacaguacacucucgacgaugaagccgauucaucaaacaccaacggaggucgcgcaugcacuagcgaagcugagaagcggcuccgagcauuguggucugaaguccucggaaucuucccagaggagucaaucucggccagcgauaauuucuuccacagaggaggugauucaauucaagccaugcgacuugcggccgcggcucgucgcgcuggcaaagcgcuggcagugagcgacuuguuccgcaugccgcggcuguaccaaauggccgagcucugggagagcagugugcaaagccaagacgcaaccauugcgccuuucucgcugcuccagccagagaucguugacgacgcuauucaggaggccguucgccaaugcaaugucgaugcgagcgacaucgaagacauuuaucucuguucggcacugcaggaaggucucauggcagucuccacucggaagcagggcuccuacaucucgacaagaaucuucgacuugccagcugaucucgacauugaucgcuucaaggaagcauggcaaaaggccgccgacgucuucccgaucuugcggacgcgcauuauccucggucgugccuccgagucucuccaggucgugcucaaggaaaagcuagcauggcagaccaucaccgaugagacauccuuuagccuucccgucauugaguacggaggccgucugugcuccuuugcgaucgacgucgaggcacgcaaauuugucuuggcccuccaucacgcucuuuaugauggcuggagugccacgguacugcuuggggcuguggaaaaguucuacgcgggugagcaauaccagguggguccaggauauaaugucuucauucggcaucucucucaaguugaucaauccgagucggacaauuucuggaaaggucagcucagugguacacccgcacauuuccccaaguugcccuccaaaacauacgaggccaagaacagcgccaacgucucucacaccauccgucuaccagcgcccgagcaucaacccacuggaauacucaagucaaccuugcuccgagcagcaugggcuaucgugaguuccaggcaugccggguccaaugauaucaccuuuggugcagcccaaucaggucgcgacugcgcugucccuggcaucguggaaguugucggcccaacuguuacgacgguaccgguucgcauccagaucaaugacgacgagaccaucgucaacuuccuccagcggguucaagagcaaucugucagcaugaucccgcaccagcaugccggugugcaaacacuucgacagcugggcaaagacguccaacccgcgcucgacuucaccacuuuguucgaguucggagaggauuccaaccagaguggcuucaucacugagauagaaaugccugagcugcuggacgguuucugguccuauccuauugucuucgagugccaucuggcucagagcggggagacugucaacguuuuggcacgacaugacccgacggucauucccacacaccagauggauuggaucugcaagcaguucgaacacgucgucgaccagcucuaccguauggcaucugaugggcucgaggcuagaaagguuggugagcucgaccucuucggcccaagugacuuuacccaaaucgaggccuggaaugcuagauggccuguggguuccaucgacggcaaggcaguucacgaggccauugccgagcaaugccgacuucauccccagaaccucgcccucucaggcugggauggcgaaaugaccuacgcccagcuagagcacuacgcgacaaaguuagccaaggcacuuguucuaaaggguguuggacucgaagucaugguuccacucugcuuugacaaguccaccugggcgaucgugucuaccauagcuaucaucaaagccggaggcgucguugugcaucuugggccuacucacccggcgaaccgcagaaaggagaucuugaaaacgaucggagccgaguuuguauuggucucgccgcaacacacuggcaucuuugaugaugcggcugucacaaccaucccaauugaccgagaguauuuggaucggcugcccgauguugacuacguggaacugcccaaggucaagcccuccaacgcagucuauguuugcuucacuucaggaagcacgggucggccgaagggaauuguggucgaacacggcaaucugcgcaugagcgcccaggcacauggugcucaauucaaggucaacccuggcaccaggguguuccaguucucggcuuauacuuucgauaucggucucggugacauauucauuucccuccaacgcggagccaccaucugcacgccaucugagugggagagguugaacgagcuuucuggagccaucaccaaauauaaggcaaacuucaugucggucaccccaucgguggccaaacuucuccgcccagaggccguuccaacacugcgcacccuuguccucgguggugaagcacccacucaggacaacgugcaaaccugguccgauaaguugaaccuaguuaucauuuggggaccagccgaaaccaccaucuacgcaucggcuaccccgcccacgacucggcaaacaagugcacaaggccucggaaacccaauggguaguguaauguggcugugcgauccagacaaccacaauaggcuggugccccuugguugcgugggugagauuguugucgagggcccgcucgucucgcguggcuaucugaaggacgaggcaaagacagcagcugcguacaucgaggauccagucugggcuaagaagcuggacaagagugccucaccucgccggauguacaaaacuggagauuuggcacgcuacgacgccaacggauauauguuauucuccggucguaaagacaaucaggugaagcuccacggacaaagaauggagcuggacgaaguggaacacgccauguuaagacacgaaagagugcgccaggcugucgcgcguaucccucggcacggaccacucaaagacaagcugguggcgauguugagucuccaugaugucucaucgaccaacucccccguugcaaacacaauuauugugcuugaugaagacugccaugguauuaagguuggacaggaacuugccuccgugcgugaguugcugcaaaagaaccuaccaagcuacaugguaccaacaauuuggauugguguugaggcuguuccgcugagcgccaauuccaagguugaucggaaauccguugaugcuuggauggaagagauggaucaggaaaccuaugccucguugcugcgcgauggagguagugauaagaaagaagaagaaauucgccgcccauccaccccgguggagcaaauucugugcaaccucaucagcaagauccuuggcuugagcucggagacacucaaccucaacucuucguuccuggcccuugguggcgacuccgucgcugccaugcaguugcguagcaagucucgcgcugaggggguuacggucuccaugcuggacauuaucaggagcaagagucucgucgagcuugcgucgaaggcggaauauaccgaaccaacugugaagaagguccaggacggguccuuugaucucucgccaauccagcagauguacuucgaucuggugggaucugcugccgacgcaaacauuggucauuucgaccagagcauucuucuggaagucaacagcgacguggcgccucaaacauugcgacaggcccucgcacagguuguucggcggcacucgaugcuccgcgcccgauacgcucgaaacgaugccggccagugguaucaguaccuugcugaagauucagcaaauucauuccauuucagcgucgaagauguggaagaugguuaucaaguguccagaauacugaggaacaugggugguguguuugacaucgaaaagggcccagucuucgcugcccgcguauauaaucuucgaucagagcgcaaacaguugauguuuguucaugcucaucauuuggugguggaugugguuucguggcacguucugcucggcgaucuggagcuugccauugccacuggcagcuuggccggcccagcuccgcucucuuuccagaguugguugcgaucucaaaaggacauggcgcagucucuugaaccacgagaccugcuacccuucucaaacacaagcaugccuguggccaacuuugaauauuggggaaugggaggcaacaagucgaacagauacugcgacgccguuguuacugacuuuuggcucgaugagucccuaacgacccaguuaaugagugucagcaaggggacuucaaacgccgccccugucgacaucauucuggcuucucuucuccacuccuuugcggcugucuucccugaccgugccgcaccaccagucuucucugagggccauggucgcgagucauggaacaaccaggucgauccuuccggcacaguggguugguuuacaacuaugagcccacugcauguaucugaucugcaauuggauauuaucaagaccgugcagaccguaaaggaucuccgccgccggcuaccggcuaacggcaugucauacuucagcuccagguaucucuccgacaaagggcgcaaagccuuugguucucauuucgauauggagaucauguucaacuaccuuggccgguccucugaaguuggaagugagaacgcccuucucucgcaugccgaacuaccagacggcgcgaccuucgaccaauugguccaagaugaaaagcuuccccgcuggucucucuucgacaucguugcccuuguuguuggcggcagaacccacguuaccauggccuacaacaagcacaugcaacaccaggauagaaucguugagugggcagccaagacaaaguccacgcuuagccuugccauugagguucucaguggggugaaaagccugccgcucacuccgccaacucccaaacccucacccgugcagcaccagcccaaggaucaaagcaucacccucgacagcauugaaggaauuuaccccugugccccaguacagcgucacaugcucgcagagcgcgaaaagcaccccaaccgccgcuuguacgaaauggauuuuacuuaccaagcucaugcacucaauggugucgucgacguggauagaauccgcgaagcauggcaccagguuauacaacgccaucccgcacuucgaacugucuuccuucccagcaugucuucacccggcuccuacgaucaaguuaucauucggaacuggcaccccgagguccccaugaucgagugcgccagugaggaggagaugacggcgcgcauggacgccuaccgaucggucaacuacagccucucgaacagaaagccacaccaucagcucaccuuguucaguacaacagucaauggcgugcaaaagauugccuucaaaaccgaaacagaccacacccuuaccgacggcguuucugucgcucugauccuccgcgaccugaugcuggcguaugagggcaagcuucccgccaccccagccccgucauucgguagcuauucugucuggcugaacgggaugagccaaggcgagacacuaguuaaggacaaggaauacuggcuagaguucgcgcggagcuccgggccaucacuuauuccucauaccgaugccuccacccuuguacuaucccaaccccggguccacaaaacaaagaccaucaaccuggauucggaaaccaccagccgacuccccgccuucuguguucagcacggugugacaauggcggcguuccuucagacggccuggggaaugguguuacagcaccucacgggaucugacaaaacucucuucuccuucaugaccgccaacagagaugcgccguucgccggcgcagcagagaccgucgguccgcucauccaaaugcuucugugucggaucgaucucagcaacaaggagauuggcgacguguugaggcaagcacgagaugacuuccucgagucgcuggagcaucaguacggacuggcccagauggaagacguguggcagaccccagcguggaauucucugaugagucuacaguacauggacucgcgagugggucagaaggccacggagcggacugaacuggagguugagcugcguucggcagaagaucccacugcgugggacgugucgaucggugugcagauccauagucggggagacgguguuacugagguagaugcagagcuuggcuauuggucugaugugcucacggaugaaagggcaggagaugugaaggauuuguuugaagcuucugugaagaagaugcuugauggauguuga

SEQ ID NO: 10 - protein, 5422 aa, Aspergillus niger
MFTQATSTTLVENVGVSHRENPDTEIAALINAAWSIVVWQYTGQEDTRFITATTSGEADDLESTYQVCNAQLDGATTISDFIQQTPQATKELASDQVPLAPSRNEAATSPFLQSITTLTSNKTYLNSSSPSHLDATGALIELVAIPLPFGKLEFVVRFAPSTIDQERADHLAAAFAHVLNLINDPDRRHDRLDAIDLVSNYDKAKLWTWNSVQLPETVESCVHFLFRQRAQEEPDMLAVDAWDGRFTYGELDDISDRIAVWLAREEGIRPESIVPLCFEKSRWAIAALLGVIKAGGAIVFIDPANPVSRRQDIMDQIEGKWVLSSKSQAETWENEMGVRTIVLDEQFAASLPVEDHILESGVTPNNLLYLIFTSGSTGKPKGCLIPHKAFISGALVHASLSNLSRGSRVLQLASYSFDVSMLEIMTSLISGACVCTPDMASMAQGLQPIFDKFDITWAFLTPSLVKLLRPEMVPNLKTLALGGEPLSKVDIETWAPHLQLINGYGPSECSVAAAGDPHLKPTSDPSNIGRAVGGLCWIVDAENHDRLVPLGAVGELLISGPILARGYLNDAEKTAASFIENPTWTEGWSLTPSDATVSSESASMRFYKTGDLARFNLDGTIQILGRKDTQVKLRGLRVELGEIEHNIARHPHIKHAAAFLPKTGRCKEKIVAVVCLKDFAQDSKSGRSDAPINVLFEDERPDVKDQADAVRNHLRECVPEYMVPAVWIVIEAWPLLVSAKLDRKRVFNWLLDMDEGLYNHLLGLLGTDVSENGSSDEKSDAHLSEVERTLRDIFAHALNTPAHGLPLDKSFIALGGDSLAAMRVISQCQRAGLNVTVPDMMKSKCIKDLAARVEKTPGMKTKPDLLDVSFPLSRAQQFCLGDGRAANHLTQSILLKLDSTVSAARVKAALEAIVTRHSMLRARFGESEGNGALSLRQTVTSEIEGSYSFQHHRIERPEDITTIAATADAVSLSGPIFSAGLVTGAEKQLLVLRAHSAVVDGASWSIIIRQLQTCLSLPDGPLLGEEAQEPVSFQNWVSVERETTGDEIAVAPRILLASEVDMDYQAVELDQATTTLLLSEEVHKPLRTHVVDFMMASLMLSFRQTFGGRETLPTLALWEDERGRASEDFGIDLSQTVGRFETLRALNLDTADMSTNDAQVRMLKGIKDARKTTMEPSSIQNPEISFRYRDLSNIIDGPRSLVQIKPRPVFLPAPGAAPLVSNISIVAEVIDENIQLAFSFNKKVVQENQVKAWIATAQETLASLVVKMVNAPVEYTPSDFPLLHGISYNTLDKLINEQLPQIGLIPGPESSLIEDIYPCSPMQQDLLLSQHRSADDMYDVYHIAELRPRDPRDPDEDFASVLANQDPISIRGPEPAHRLSICRIAGASHVVIKLEMNHVIVDGVSAAVIVRDLLQAYDGHAAQLEPAMPFRHYISHIRETPLESSIDFWADYLRGQSATMVPRLASLETENQGERQLNVVSVPLKEEGVSNEALLDFCRRASVTPANVFQAAWALVLRAYAESPEQVCFGYLSAGRDAPLPGIQEGVGAFLTMLVSRLSFATEEKENEGDKTATVTTLLDAVHIVAEDYVNALPHQHVGLSNIQHALQTGGSPLFNTIIAVNRDVDSPADSSLIFKNIGDHEPDEYAIVLDVQLNGSNTARASLRHWTDHLTAKQAGNIASALGNAVQAIITRPDTPISEVELVGVAHTDQLLSFNTHQLPRANRLIFTNFEKLARVQPHAPAVCAWDGEWTYSQLDEVSNRLAHYLRTLGVGPEAVVPHCFPKSGWTIVTCLAILKAGGAFVGLDPTHPKKRLEGLVQEAGAKVVCVAPQNRDLFEGCDNLSIVEITPEFVAKLPSKSGPACGYIQPNNAACVVFTSGTTGRPKAVVVEHASMATLSDLMGPAVRIGPEARVFQFASYTFDTSNQDIFTTLQRGGCVCVPSDEDRVNDIPGALNRLRANHAHLTSTVISLMRPEQVPQLRWLFSAGEPLTRENVEIWAPAVELYNSYGPAESSVAVTCTPTRLSPSGSPANIGQAFGCHAWIADPTDYHKLMPLGAVGELLLEGPLLARHYLNNPEQTAAAFVQNPRWAKSMSPDQNRRFYRTGDLCRFNRDGSLTIIGRRDSQIKIHGQRVELDHIKYEVQAQLAQLDQSSLVSVDAVMLPKAQIQDRTLVAFVQFLDEAPAKPLDTLSIPMTERLARLFSDLQRALKSSLPQYMVPAMFVPITQIPRTANGKLARNVLREIIAGLSEADVSRYMLQGETAKKAPTTPREQKLQAAWSKVLNLPLEKVGASDDFFQLGGDSVVAMRLAGAARVAGMSLTFADIFANPVLSDMAQVVRMGDESGEQETDEKAFDLVPLSSTSSLQTIRAEAATQCGVRPDAIVDMYPSTPLQEGLVALSMRQTGAYKDQRILRLTDPNYDVSRFRRAFDAVVSAEPIFRTRFVSVSGAGLLQAVLNVPVDWIKRDNLAAYLEEDLNAPVTYGSALIRLAMVEENGERYIVWSGHHALCDGFSMDITFEQIAHAMAHEGSVVSKPVSFKGFIRFLQDQDRDSSAREYWQKQFPADGEAPPQFPPRPQGHQVVPHRACRLQFQLNRPAGTKISVTNYLRAAWGLVVARHQDSSDVLFGVTLSGRNAPVAGISTMNGPTMTTAPFRMTVPLDSDTTVAQYLDALHQQAITMMPFEHTGLQNIRRLNELARAAVDNMGHRFAVEPSISDVSEALDGMEIVSADLPEGFYTDALVIRNYDHSDGAIVVEARYDHTLISDRDMQRLLSQYNHVVQQLTSQPETCIRDIQVLSPDDISEIMSWNGDLPETVQGCVHQLVAERAKERPDAEAVCAWDGSYTFGELDGVTERLAAHLQNLGVGPEVTVALCFDKSKWNVVSMLSILKAGGCYTALSPAYPAARMQDILQDVQAPLVLCSPHHADKFSGMAPKVLPIDDASFEYLPKQTTTHRVTSAVQPSNAALIVFTSGSTGKPKGAIIEHRGLCSMQHYEGPHVQMGPDTRTLQFASHVFDVSNSEVFTTLMRGGCVCVPSETERLSDLAGAVNKYRVNWSFHVPTTAETLDPEQMPGLKHLALGGEAISQGLCDRWASRVTLLNSYGPSECSIWTSVSHLQPGTSSPNNIGRGLGCRTWITEANDHNRLVAIGCVGELCVEGPIVTRGYKANPEQTAAAYIENPAFARTLGIQAMRIYKTGDLVKYDADGNILYVGRKDSQVKVRGQRIELSEVEQNIVAHGIDADAVVVEKVFLNGNKDRVALAAFLRLNASSESTGASGDVESMDVVRDQLVALKNHLLDTIPPHMVPSFFIPLRSMPVTQTGKKNRKALRTLGASLSSEQRQQYTLDDEADSSNTNGGRACTSEAEKRLRALWSEVLGIFPEESISASDNFFHRGGDSIQAMRLAAAARRAGKALAVSDLFRMPRLYQMAELWESSVQSQDATIAPFSLLQPEIVDDAIQEAVRQCNVDASDIEDIYLCSALQEGLMAVSTRKQGSYISTRIFDLPADLDIDRFKEAWQKAADVFPILRTRIILGRASESLQVVLKEKLAWQTITDETSFSLPVIEYGGRLCSFAIDVEARKFVLALHHALYDGWSATVLLGAVEKFYAGEQYQVGPGYNVFIRHLSQVDQSESDNFWKGQLSGTPAHFPKLPSKTYEAKNSANVSHTIRLPAPEHQPTGILKSTLLRAAWAIVSSRHAGSNDITFGAAQSGRDCAVPGIVEVVGPTVTTVPVRIQINDDETIVNFLQRVQEQSVSMIPHQHAGVQTLRQLGKDVQPALDFTTLFEFGEDSNQSGFITEIEMPELLDGFWSYPIVFECHLAQSGETVNVLARHDPTVIPTHQMDWICKQFEHVVDQLYRMASDGLEARKVGELDLFGPSDFTQIEAWNARWPVGSIDGKAVHEAIAEQCRLHPQNLALSGWDGEMTYAQLEHYATKLAKALVLKGVGLEVMVPLCFDKSTWAIVSTIAIIKAGGVVVHLGPTHPANRRKEILKTIGAEFVLVSPQHTGIFDDAAVTTIPIDREYLDRLPDVDYVELPKVKPSNAVYVCFTSGSTGRPKGIVVEHGNLRMSAQAHGAQFKVNPGTRVFQFSAYTFDIGLGDIFISLQRGATICTPSEWERLNELSGAITKYKANFMSVTPSVAKLLRPEAVPTLRTLVLGGEAPTQDNVQTWSDKLNLVIIWGPAETTIYASATPPTTRQTSAQGLGNPMGSVMWLCDPDNHNRLVPLGCVGEIVVEGPLVSRGYLKDEAKTAAAYIEDPVWAKKLDKSASPRRMYKTGDLARYDANGYMLFSGRKDNQVKLHGQRMELDEVEHAMLRHERVRQAVARIPRHGPLKDKLVAMLSLHDVSSTNSPVANTIIVLDEDCHGIKVGQELASVRELLQKNLPSYMVPTIWIGVEAVPLSANSKVDRKSVDAWMEEMDQETYASLLRDGGSDKKEEEIRRPSTPVEQILCNLISKILGLSSETLNLNSSFLALGGDSVAAMQLRSKSRAEGVTVSMLDIIRSKSLVELASKAEYTEPTVKKVQDGSFDLSPIQQMYFDLVGSAADANIGHFDQSILLEVNSDVAPQTLRQALAQVVRRHSMLRARYARNDAGQWYQYLAEDSANSFHFSVEDVEDGYQVSRILRNMGGVFDIEKGPVFAARVYNLRSERKQLMFVHAHHLVVDVVSWHVLLGDLELAIATGSLAGPAPLSFQSWLRSQKDMAQSLEPRDLLPFSNTSMPVANFEYWGMGGNKSNRYCDAVVTDFWLDESLTTQLMSVSKGTSNAAPVDIILASLLHSFAAVFPDRAAPPVFSEGHGRESWNNQVDPSGTVGWFTTMSPLHVSDLQLDIIKTVQTVKDLRRRLPANGMSYFSSRYLSDKGRKAFGSHFDMEIMFNYLGRSSEVGSENALLSHAELPDGATFDQLVQDEKLPRWSLFDIVALVVGGRTHVTMAYNKHMQHQDRIVEWAAKTKSTLSLAIEVLSGVKSLPLTPPTPKPSPVQHQPKDQSITLDSIEGIYPCAPVQRHMLAEREKHPNRRLYEMDFTYQAHALNGVVDVDRIREAWHQVIQRHPALRTVFLPSMSSPGSYDQVIIRNWHPEVPMIECASEEEMTARMDAYRSVNYSLSNRKPHHQLTLFSTTVNGVQKIAFKTETDHTLTDGVSVALILRDLMLAYEGKLPATPAPSFGSYSVWLNGMSQGETLVKDKEYWLEFARSSGPSLIPHTDASTLVLSQPRVHKTKTINLDSETTSRLPAFCVQHGVTMAAFLQTAWGMVLQHLTGSDKTLFSFMTANRDAPFAGAAETVGPLIQMLLCRIDLSNKEIGDVLRQARDDFLESLEHQYGLAQMEDVWQTPAWNSLMSLQYMDSRVGQKATERTELEVELRSAEDPTAWDVSIGVQIHSRGDGVTEVDAELGYWSDVLTDERAGDVKDLFEASVKKMLDGC

SEQ ID NO: 11 - DNA, 25304 bp, Aspergillus niger
attacatattatcataggttactaccccgaggggtggcctaagtggtgagataccacctgctcccgtgtatacatgtctatataagcaggattctaggggtccgcaggtagctgcgggtaatgatggtctttttagccttgtggtagcaactcccctaggttgttctctgacacgtatgaagtaatataatagttttataatatatatataattatttataacttcaagacgtatcccgcgatatataatataaatataaaatgattttaaactcatatataaagataatatatattaataaaataatagtaaataacctaacaaacctcaccctaaccggctaattatatgatacttttatttgattatcaataatttttaataaccttactactagcttatataaaccataaatatctttaatattagcctcatcacgcccgccctcgggcccctatgtaccgcgtaagtttgacatttgagattgaattatatatatctctgccaatactcagaacaatcttcctatactttactagtagattagaaatactatctatactatatgcactcaatatcatatcctgaatggatatggttgttgaagtatgaaaatgtaatttatcgcatttagtatgatgttttagggtgaccgagacggccgggaatgttacgttagagccgggtatatatgactaagcgctagatgataactagtatcttacgtcgggtagaacgtaccaatagcaatatctttagcatgtccatcttattccgtaacatactactctgacactgccgcctgttgcgctgctaccaaggacggcagcagttttctaataggggcagttgtcacggcagtagcctatagttaactagagccggggttatatgactaagcactagtgcagttcccacgggtccactggtcattcaagcttgtggattcggctcggcgcggcccccaaccatagttggagacagccctaaatgtgatgggaatgatctacggcttgagcgagagcgatcctggggtcttgggggctatggagtaagctcaattgcttctccaaatagtaatcaatacgcgcaaccctcgaatttgaaatttcttcgatttttcagccttccaactacctcaatgcctcatttccggttttcattgatcttccaaaaattaaatttatcctaaacccatccaagactctgataagatttcctacgtttgctttagagatgatcatcattgtaatattcattagaagcctcataatcacgttacgtacccactgcacattgcctgatgtgccacggagaaccagggatcctaagcctccactcttgtatctgtttgtctcactcgtaaggcaaccacctgtcggatgcaaatctaggcttccgctgaggtagtatcggattgttgcaagatccacagtggagccaaaaagaacacgaaaagcacaaagaaagggctttgaaagttcatatgctttgtttgttttttgcgttttttagtcttcaaatcttccttgagattgtttcaagacatctatgtataatcagatgacggagagcaaactttggagatatttcgtcagaaacgacgcctcgcactgacgagcggttttagagacaatgaccctgcagatcagggtcattgtctctaatggatttggccccttagcacatgtttgctggggaaaacttgctttggcgctgtaggattcagatgcaacagtatactgcatatttgcttatgtgctttccgactaagcccaagatgacgacctcggaaattcattgcccgtcgggggagtctggccttaatggcgttttactagcatagttacagtgttggtactatagctggcacatcttcatatattctgctgatgccccgtccaaacatcttaaaatgagaagagtccacagaataccatcaattgcttcataacaatacactcatcaatccctcaaacgatcaataaatcttatcaaaatgcgatctcccaatgatcttacaacatcagcaaccatggaagatattcatcaaatatggtcttggaacgctaacgtgcctgaggcgggtgagacatgcgttcacaccctcatcaccgacaaagctctccagcagccagatgcacttgccgtcgacgcttgggacgggaggtggacgtatggtgagcttgagactacttctaccaaactggcattgcgtttgcttgaccttggagttggccctggaaccaatgttgtcatatgttttgaaaagtcgaagtatacgcctctggctatgctggccgtcatgaaggcgggtggagcctccattgcgctcgatacaagccaaccacagacacggttacagtctatcatcaaccaggtcgaccctgtagtgatactatgctccgcgtccaagagtcagttggccaagtcaatcatcaccgagtctgcagtagcattgacaattgatgaaaattctctatccgaaatgaatttcgagccggactcagtcgcccgtctccctgacgtcagtctggacaacaatctctacgtggtctttacctccggaagtacaggaactcccaagggcgtcgtcgtcacacatctcaattactccactgccattctccaccaacaagaagcgcatggcttcaagtctacttcaagagtgtatgactttgcttcgtatgcttttgatgtgagttggtcaaatctcatccacaccctcaccatcggcgcctgtctgtgtattccatcagagcaggaccgtaaggacaatctcatcgagtccatacgctcactgtgtgctacacatatcgatgtgaccccgtctgttgctcgccttatccctgattccttgctctgcaagattgaaacacttgttttaggtggcgaaaagctgcctgcagagcttgccagacatttgtcatcgctggtaacattgaaaaatccgtatggaccgagtgaatgtacgcctacatcaactatcgctacaattcgaccggatgatgatgattcaaaaattagcagcattggccgaggcttgggtgtcaacacctgggttgtagacagtgagaatgaagaaattttggtgcctattggacaggttggagagctattacttgaagggcatctgcttggcaatggctacttgaacgaccagacgaagaccactgcggcctttgtcaacaatccgctttttctgctcaatggcggcgatggacctgggcagcctgggaggcgcgggcgtctctacaagaccggcgacctggtccgttacgagaaagacggtagcttgacatttattggccgtaaggacacgcaagtcaagattaacggccaacgagttgagctgggtgatattgagcatcatatttaccgccacatcccacatggcaccgtgtctgtgcgacaaattgcagcagaaattatttcaccaaagactggttccaatgctgtcctggcagcatttctcgaggtcgaccttggtgtagaggatacgggaatagcggaacagttgttttcaaaaaccgagaagatgatgtctaacttgagaagcaatcttgctcgagatgtcccttcatatatggttcctgctgtattcattccgttgaggaacttcccattgtctccgacaggcaagacagaccgacgccaactgcgggccattggtgaatcaatggacttgactgtcttggcaggctttggcgcagcacctaatgaggctcggatccctctcactctgcgagagaaacagttgagaagactctggggctctatcctcaggattgacgaaaaccttattgctctcgacgataactttttgcaaagagccggcaacccaaatgcagccatgaaactcgtcactgcagctcgaagagaaggcttctccctgagcgtggccaacgtgctgaagtatccgcgacttcaggacatggcacaggtggttggaacagtggagcaagagcaggcacatgaaattatgccatttgagcttctgagcgatgatattaatcttgatctagccctcagagaggctgcagcatcgtgcaacgtacaagggaatcaaattcaagacatttatccctgcacaccgctacaggaaggcatgatgtccctatccgcaaaacgcgagggtgattacatcatgcagtatacgctggagctacaccatcgatgcgacatagagcgcctaggtaaagcctgggcgacagtagttgctacgacgcccattttgagaacacgaattgtcgacatcactagccaggggttggtacaggctgttctagacgagcagtggtcaagttcgtcgatccaaaggaggaccttgagccaggcgagagaccacaagcatcaattcgggctaggcatgccattaggcagatttgaaattgtcaccggcgactcgtctgattttaagcactacttcgtctggacactgcaccatgccctgtatgacgggtggtcacttcagcttttactcgaaaagctcgagaacgagtacgccggaaaggcagacgcgcagtcaaactcacccgattttaaacgttttatcaagtatatttcaacgagggatggcgagaagactcattcgttctggaccgaacagttccaagacgtcgaagcccagatctttccgagtttgccatctgtcgactaccagcctagatcggacaaactgtacactcattctgtgggaggaatacaatggccaaaaaatggaatcaccccatcgacgacaattcgtgcggcttactctatcttgatatccagtctgaccaacagcccagatgttgtcttcggcagcataacgacgggcagacaagccgccgtggatgaggttgaagagcttattgcaccaactatagccactgtacctgtgcgcgtttcgatcgacagcaaagacgagttgggacagttcttacagcgaattcaatctcaggccgcagatatgattgagtttgagcagactgggctgcatcagattcgacatatcaatgcagatgcggagcgagcatgccagtttcagacactgcttgttgttcagcccgcggagggctcgggcacagcaccgagcgacatttttaccaacattcccgacgacataaggaaaggagatggaaacagcgccgcagagctggggacttatgccttgactatggagtgtctgctcaagaaagatggccttgacctccatatgaactattgttccgcagtcatatcggagcatcaagtgcgccgtttgtcacagcagtttgagcatgtccttggtcaaatatgtcatctgacgatgataattcacagacagagaacaacacttgaatcgctgcggcagccaacaacggaaactgagcggcagatgcagcgaatctgggcacaggtactcaaccttaatcaagcatcaattgggctagattacagctttttccaactcggcggcgactctattgctgccatggaagttgtgacagaagctcgtaagcttggcttgaaactggctgtgtcagacatattccgtcgcccgaaattgcaagacgttgcaaagaaggcttgtgacagtggcctgcagctttatggagaagagcagctcatgaacgactcagaagtccaagttaaaggaggtaccgagcacactaagctacccaatgatgacaaggcagttgctggccatgaaacgcagcaagtcatggtatgggagggaatgttcgataaggaggtctatggaactattaatgatgtccaattggagaagattgggcgcgacttcatcggatggacgtccatgtacaatggcaaccaaatagacaatgtcgaattgaacgagtggctagacgatactattgccacaatacgcagcagcggatcgacagccaacatactcgagctggggtccggcagtggaatgatcttgttcaatcttgtcaacggcctgcacagttatgttggacttgacccgtcagaaaaggccgtggacttcgtttgttccacagttaaatccattccccagttggccgaccgtgtctataatataaagggaacagcagacaacatcaacagcctaggcgtacccatctctgctaacatggtcatcgtgaactctgtcgtccagtactttcccagtcaagactatctgctcaaagtaattgaggacctagttcagctggaaacagtccgcacgatctttttcggcgacattcgctcctacgcgctgtttcgagagttccaggttaccagggcgctgcatattgcaggagatactgcaaccgaggacgagatccgacagatgatggccaacatggagcaagtcgagctggagttgctggtagatcccgcttttttcacatccttagtcgaccggttccctggactcgtcgaacatgtggagattcttccaaaaagattgaagtcgacgaatgagctgagtgcctatcgatacgctgccgtcgtgcatctcaaagactcaaaccaactagctcagccattacaagtccacgatatccagaaagagagctggattaactattccgggcgtcaactcaatcgtcagtcgctgttacaacttgtacaggattctttcttacgagacccgtccccctcatcagttgtggccgtatgcaatataccttatagcatgacagtctacgagaggcacgtgattgaatggcttgatagtggcctcactgccggtcccgatgctgaggactggctctcttctatccgccaaacatcacaagaatgctcatcactctcggctctcgatctgcaacaaatagctcaccagacaggatggcaagtggagattagctggagtcggcaattttctcagcgcggtggcttggatgccatattccaccgacaccattcacgaggagaccgaaccagcagggctttgttcaacttccccacagattatcaaggacggccatctcaatcgttgagcaattggcctttgcagcgcaagcgacagggagaggaaaagcaaataactttgggagatgtttctaccgtctgcaaagaggacttgcatgacatctggacttggaatgaagttgtcccagacgccctcgaggcctgtgtccacgatctcatctcggacacagtaagagctcagcctcaatcccctgctatttgtgcttgggatggtgagtggagttacatcgagcttgatgatttgtctagccgtcttgcacacgcgcttgctccgtttggcgttgccaacacagttgtacctatatgctttgaaaagtcaaaatggacaccagtggcaacgctggctgtgatgaaggccggggcagcgtcagtcaccctcgatgcctctcagcctctggagagattacggtcgattatctcccagactgaccctcgagtgatcttgtcatcggcgtctaagcagggcttgggtgcccaactcactaaagctccaaaccttgttgttgaccaacattccatttctactatgcacatcaccgccgagcctcttcccaccgttgacccctccagcaagctatatattgttttcacatctggcaccacgggtgttcctaagggcgttattatcacacactctaactttagcagtgccatccgacaccaacaaaaagctcatggtttcaaatcgacatctcggatttatgactttgcctcatacgcgtttgacgttagctggtctaacttcatacatgcacttactgttggtgcctgcttgtgtattccgtcagatgaggaccgccgtgatgacttggccgggtcgttggagaggttcggcgctacccatgttgacatgacgccttccgcagcaagcttgctcccagagaagtcattcaaaaggcttgagacggttgtactcggaggcgagaagctttctgtcgagagcgcacagcgctggagctcactagtcagcctcaagaacccatacggtcccagtgaatgcacgcccacggctaccattgcgacggtaacacccaccgatgagtacaaatccagtattggaagaggactaggtctgaatacatggattgtaaatactgttacagactctttagttccagtcggcggggtcggagagctcctgctcgaggggcctctcgttggcgcagggtacctcggcgatgacacgaagacggccgcttcctttgtggaagatcctcagttcctattgcaaatatgccctcaaggtcaagcaagacataccagaatgtataagactggcgatctggttcattacaacccggacggaagtcttagtttcgttgggcgcaaggacgctcaggtcaagattcatggtcagcgtgtcgagttgaccgagattgagagccatattcgtcgcacctctaagactatccaggtggctgttttgtttaccaagtcagggctgtgtgcaaatagggtagttgcatttgtctgcatccagggaactggccaaactcagacagccgccgatcaaattcgactcatcgatcccaagtattcgacccttgttacggcttacaccgagtccgcaaagtctagtctcagcgacactcttcctgcttatatgatcccctcaatttggattccactccagcatgttccgttgtcaacgtccggaaagctcgattacaaagctttgaaatcatggcttgatagcatggatgccaagacgtttgccaatattttatatgcgtctgatggcgacgtgaagcttcgcaaggctgagacagaattggaacaggtcatagtagaggcttgcgctaaaattctcaacattacagcatcgaaggtgaacctggatcggtcgttcattgcgaatggtggtgattccatctccgccatgaggctcgttgctcattgtcgcgcggacaacgtcgtattttcggtggctaaattgctaaagagcaaaactttggccgctttggcctcatcttcaaaaatcaagtcagcttccaacgtgttgggcttctatgaggaaaaaagtgactcttttgcgttgtcgccgatccaacagtggttctttgaacaaggtctctacaagagatccaatgacaacttcgacaatcaaggattttatctcaaggttaagcgcccattattgacaaaggatattgactcggcgatttccaaagttgttcagcatcactctatgttgagagctcgctttcatcggaacggcgacgagtggacccaaaaaacgcttaagcctgacaccaatggtttatatcactttggtgtccaccacacgtgccttccagctgatatagagcgactagctctatcacgccaccagatgatcgacatcgaaaaggggccagtattctctgctgacatttgccataatgcgtttggagaacagtacctgatcctgattgctcaccatcttgttgttgatttagtctcgtggcgtgtcatcctggaggacatagaatctctactcggtggtagtaatttgcaaccaagtcttccatttcaagtctggaatgatatgcaaattgagcgggcgaaggaatcgagcctacttgatcctgaaaatgttctatcaaccactggaattaataacaacctcgatttctggcaagccacagcagaaaccaagaacaccgtcgaagatcacctaaatttctgtaccaagatcgacagcagcattacagagctcatcctcaaagacgcaaattacccgttcaacactgaacctgtggacctccttcttgcggctgtttggcatgcattcttcaagacgttcccccaaagagacggtctcactatttttattgaaggacatggtcgcgagccgtggtcctcggatattgatctttcccgcactgtcggttggtttactaccatcagccccattcatgtgtcaaagagcgacgtacacaagtctgtcgcaagtctagtacgcgttgtcaaagatgctcggcggctcctgcctgcaaatggctgggcttactttgcttctcgatatttcaatgaatcgggaaaatcagcgttcaaatcgcacgactctattatggaaataacctttaactatcacggccaatttcaacagctggagaacgagaaggcgatgtttgaaaatgttacgctcagtggagtctgcgagcaaggaccagctcttcccgcctcttccttgattgctgtcgaagtctcgatagatcgagggcaggtcaccttcgacgtttctgccaaccgctacattaatcaccaggattgtatttcaaattggatcaaagcaatttcacagtcattggagaccatttccaatgagcttgtgtctacagaaatctcacatcgcacgctttgcgactacgaatttctgagcctcgggtatacggagctggatcgattacaggaaagtgtcatcccagaaattgagaagctaaataattccacagtagaatgcatttaccgctgtcttcccacagttgatggtattctgatcagccagttcaaagacccagaatcgtataaaacagtgcaacatttcgagattacttcccacatcgacgaccaaatcgacctagagcatctttctctagcatggcaaaaagtggttgccaatcaacctgctctacgaaccgtctttatccctggcatggacaaagccgctgcattcaatcaagttgtgctgtctcagtaccacgccgagctcatcatcctgcatactgccagcgacgagtacaccgaagccttggagatgttcaagaatttaatcccaatcaattatcagagcttcaagccacctcatagagccgcgatctgtcgaatctcacctagtagagtactctgccaggttgagatgagtcatgccatcacagacggtgcatcgacatctattttggccaatgatcttctccaggcatacaacggcaactcgatgccaataaatctcatggacacagcatgtgagtttgctcgggcccaactcacttcctcttttggggaaaaactgtcatactggaagaaaaagctttcgggaatggatccctgccacttccccaaaatctcgggtgcttcaacacaaggcaccggtacatccgtctgcaaaattcgtggcgctctgtttagcaaaatccaggattattgcaattcagtagaagtcacgacggccagtttatttcagaccatatgggcacttactctggccgcctataccggcaacgactcgacatgctttgggtatctagcatctggccgcgacttgcctattgctggcatcgataaatctatcggtgcattcacaaacatgttggtttgtcgagtcaatattaaccgagaaactgaaatacttcaatttgttcagactgttcatgatcaagttatgcaagatctggagcaccagcactgctcactagcaagcatccagcatgaactaggcataaattccgataaccctcttttcaactccatcctatcatatcagaagcaggacgatgagccggcagagacgagggtttggtcatcaaggccttggacggacaggatcccacagaggtacgttgtatcgcatgtcaaagttctttacggaatctgacaaatcctagtacgacattgtgttgaatattgggcacgctaccgaccacatcgaaattgtttttgactataaacacgcctgcctttcaagcatccaggcagagagcgtactttcactcatgcaatctacagctgccgctctagttcagcatgcttcgggagatcatcagactttaagaagcgtcaacatggttagcactgaagatatatctgacatatggcaatggaactcagacgttccagtcactgtcgacgattgtgtgcatcatatcattacgcgaacttgtcataaacgcccccaagctccggcaatctgtgcatgggatggcgattggacctatgctgaagtcaataagctgtcagataaacttgcccaccttctagtctcctatggtgttggccctggagtggttgtcccgctttgcttcgaaaagtcaaagtggacacccatagcaatgatggctgtcatgaaggcaggaggcgcatctgttgccatggactcaacccaaccagaggaacgcctacgagcaatcgtaaaccaagtgaagtcacctattatcttgtcatcatttgccaacgaacagcttgcaagccgactaatcagcgagcttcccagccccaccaaggtcctcacaataagcgacaaagaagtggaaaatttgaatgttccgagtggaagccaacttcctcatgtcaaccccagtgatactctctatgtggtattcacatccggtagtacaggggtgccaaagggagtggcagttactcactccaacattgccagtgcgatcaaacaccagcgacacttgcttggattcacttctgaatctagggtattcgacttttcttcctatatgtttgatgttgtctggtgcaacttactacagggtctttctgctggaagctgcgtttgcatcccgagcgacaatgaaaggaagactgactttatggccgctattgttaagatgagggcaaaccttgtcatattgacaccttctgctatccgcggcctgaagcttgacgctctgaacagcctatgcaacgtccacttcatcggcgaacctttacatgttgacacttttagatcagttgacgaaagtgtcacgatatccaacctatatggccccactgaatgtacaacattcagcacagtacaaaccatctgcggcagacagcatcagtcaatcacaattggcaagggagcgggtctgaatacctgggtcgcggacatagccactggtacggctcttgtaccaattggcagtgcgggagagcttctacttgaaggcccattagtcgccgccggctaccggggtgatgctgtcaaaaccgctgccgcattcgtatatgacccgccatttcttctgcgtggatcggtgggccaccctggtagacgtggccgcctatacaaaaccggagatattgttcggtataactccaacggtactttgactttccttggccgaaaggattcgcaagtcaagatcaacggacagcgagttgagttcggtgatattgagtctcacataaacggggcgctgctaccggacttcagtgaaggtcaagctttagtcgactttgtaacacctcaaggaagctcacgtccaatgcttgtagcttttgtttacttcggacctactgtcactgagggcatggatgaggccgatctgctaagcctagccaagcgcacagccatatcgctggatgagagtcttgctgctcgaatccctgcattcatgataccatctgcttatattccattgcagaaaattcctgtcacagcgacaggcaagacagaccgccgtcgtttacgcgagatggccaaagatgttacctgggaccagctcattaaagctgactcccacggtcctgatcgttgtcaacctggcacagagatggagatacagctgcagatcctatgggggactgtgctaggagttgaaagtagtttgatcggtgcacatgacaacttcatgcgcgtcggtggtgattccgtgggcgcaatacgcttagcgagttctgcccgggaacttggtttcacgctgaacgtggctgatattctcaagaacccgaaactaagtgatatggcaaaacttatgatacgaacagagccgtcgcaggatatttcaatcaaggaattctctctcctcaaacctggctctgatgtcaactgggctgttgcagagacatccgctttatgtggcgtggacggtaaccaagttgaagatttatatccttgcacacccctgcaagagggcttgctggcgctgacaacaaagcgccccggcgactatatcatccggtgcattttggaactgaagagatcaacagacgtcaaaaagttctgcgcctcttgggaggcggtgttggagagcaccccaatactacgaactcggatcgtagacatcgcggaacaaggtttggtgcaagctgtcatcaagcaaccagcacagtggacatcggcagaagcctccagtttggtcgacttcgtggctgctgataatgagaagacaactggtctgggtatgcccttggtgcgattcggactagtacaagagacgaacaaacacttttttgttttgactctgcatcatgcagtatatgatggctgggcgctgaatctggtcttcgaaaagctcgaaaatttttatgctgggtcttccaggcatgaaagcccggatttcagacacttcgtcaagcacatttcaagtctcgacaacgacgcggctgccaagttttggaaagaccaactccaaggctcagaggcacccacttttccctccttaccaactgccacgttcgtgcccaagtctgaaaagaccattttgcacacagttgaagagttgcagtggcccaagactaatgtcactgcttttacgttggtgcgtgcggcactgtcacttttaacggcggcctacaccaattcagaagacgtttgctttggcgtgacttccaacggtcggcaggttgggctccctggagtagaaagaatgataggcccgactattgcgacagtgccagttcgtgttcgcattgaccgcgagcagcgtctccaagccttcctcacacagatgcagcatcagtccattgacatgatagcgtttgaacaatttggtctgcagcaaatacggaagtcaagtcctgacgccgaacgggcctgtaacttccagtcacttctcattgtccagccggcagaagagacagcccagtggcagagcgatataattgcccgtgatatcggagaaggagctgatgatcctatgggcattcaagaaattggaacatatgcccttactctcgaatgccatctcggacccgacagtttgctcataaaggccaactttgattccaatgtaatcgatgaactacaggtcaagcgatttacaaagcagtttgagcacgtgcttcgtcaaatatgctgctctggtagtggccttgtcgtttctgatattgataccaccagcagacaagacatggaagatatttggaagtggaatgccgtagtcccccagtcagtcaacacgcctgttcatgagctcatctcctctgtggcacgcagactgccgcatgtccaagctgtatgcgcatgggacggcaactggacttaccgtcaactggatgacctgtcaaattatgttgcgcaccacctcgtcgaccttggtgttggctctcaggacatcgtaccgctgttgttcgagaagtccaagtggatgccgatcgcgatgcttggtgtcatgaaagcaggggctgcgtcggtggctgtcgataccagtcagcccaaagaccgacttcgcatgattatcgaccaggcaaatcccacggtcgcgctaagctcagctgataagttgcctcttgtccggagtctgacaaaggcgcaaagcttcgttgtcagtggccaaggtattgaccgcttattaaaacctagccttaatgctacacttccagttgtcgatccgtccagcagactgtatttggtcttcacctctggtagtacgggtgtcccgaagggtgttataattcgacattgcaattttgccagtgcaattaaacaccagaaagaagttcaaggcatccttccaacctcgcgtgtctatgattttgcttcatatgcatttgacgtcgcatgggccaatgcgctactgacctttgagagcggcgcttgtctctgtatcccatccgatgctgacagaaagaatgatctaaacggttcgattgcgcgactgaagccaactcacgctgatcttacgccttcggcagcactggtcctgtccaaagagtcacttcagcagcttgataccctcactttaggtggcgaacgtctcctagcggagtacgcaacaaagtggtcccagtttgtgacagttaaaaactcatacggaccaagcgagtgcactccaactgccacatttaccgaggcaattgggcgtggatacgatcttggtgctagcattggtaagcctgctggtctcaacacttgggtggttgatcctgtgacggggcagtcgctcgttcccattggaggcgtcggcgagctgttcttggaggggccgcttgtcggtgctggctatcttgatgatgcagagaaaacgaatgctgcttttatccatgatccaccatttttgctccgcggcaacgttgtcgcgcaacctggacgacgcggcacgctgtacaagacgggtgacattgtgcgatacaactcagatggcagtctcacttttgtttgtcggaaagatacacaagtcaagatcaatggccagagagtagagcttgctgagattgagagtcatatagctctatacacagcgacccgacaagtggcgaccctattgcctagcactggcctctgtgcaaacaagctggtagctatgatcagcctcacagatgtgaactatgatgttagcgaggacctcgccgaaaacaagattgagctggcatcttcggaacatgaccaactcatcaatgagcacatcgaggcccttcaatcgttattgcgcgagtctttgccgcagtacatgattccatctctgtgggtggtcttgtacaacctccctatgacagcatcgggaaagcaagacaataaggcactcaaatcctggctggaaaatatggatgaaacgctcttttctaaaatcaacaatgcgaacggtagcgacattatccgaaaaccagacacagaagacgaaagagtcctcagccagaaatgcagtattgtccttaatatgcccgtcgacaagatcaatctcgacaaatcttttattgcgaatggtggagattccatttccgccatgaggcttgcatcccactacagaactgtgggaatttccatctcagtctcaacactccttcaaagtaaaaccctcgcggatttcgcagcattttcgggcgcaacagccattagcggagtcagtcaggaagagcatactgacgttcctttcgaactatcacccatccagcagtggttctttgaccaatcgccatttatgagccagcagaagcatgacagattctacaaccaaggattctatgtgagactcaggcgcacagtgagaatcaatgatctagaatcagcctttctttctctggtcaatcgccacgcgatgttacgctcgcgatttcagcatcatgggggcaaatggaagcaaataatcctcagtcacagcaaacgagctcttcatttgaacgtatcgcagcacctgtccatgagcgagattgcatcgttagctcaagagcggcaccgacagattgacatagagaaaggtcctgtcttctcggttgatatttgcttactaggccagcagcagcatctggtcatgatagcccatcatttggttaccgacttggtctcctggcggattatcttagatgatctggagactattctcaacggccattccctaacggccgctctacccttccaagtgtggagcaggctgcaagctgagcgggctgtatcttccactttgaagcctcacaacttgctgtcgactgacggcgtccataacaatctcaagttttggaagtatacgcacgacacgcccaactgcttggcagaccacaggctccgatcggtcactattgatcgagaaactacggctgtactactgggcgaggcaaacaatgccatgaatacagagccagtagagatccttttatcagctgtttgggatgcattctttcggacgttttcccagcgcaacagcctgaccatattcaacgaaggtcatggtcgcgaagcttggtccgatgaaattgacttgtcgagcactgttggatggtttaccacactcagtcccatcaacatctatagaaataatgccaccagcgagaccgacatggtgcggctcgtcaaggatgcccgccgcagccttcccgcgaacggctggtcttactttacctcccgatatctgaaccccgacgggcaaagagcttttgaaagccataacacggtgtctgaagttgttttcaattatcatggccaattccaacaactagaaagtcatcaagccctttttgaagacattgatcttgtcggtgtacgtgtgcaaggtcgctcaatatctgcagggtctttgtttaacatcgaggttgccattgaagcaatgcaagcgcactttgaattctccgttaatcaaaatatcgctcatcagagcttgattaaccagtggattgaccaaattcaaccctctttggaaaggatttgcctcgtccttctcgaggccaacccaacgcatacgctgtgtgacttcaagttcatcagtctcgactaccagcgccttgacgatcttaccagtcgactacttccggagatcgagtcaatcaaccaatcaactgttgaggagattttctcgtgctctccgattgtcgatggaatgctcctcagtcagataaagcagccagaatcatacaagacacttcagcgatacgaggtgttgtcatctcatgaccatcctatctgtctcgacaccctcaaaattgcttggcaaagggtgatttctcgccagcctgccttgaggacagttttcatcgctggccttgacggatctaccgccttttaccaggcccttctcaaacagtgctccggggatgttatcgttgttgaggctaaaactgaagaggaagccctgaaagccttttcctcgcttccgaaagtcgattaccaacaggccaaacctcctcatcgcctcactctttgtcaaacgccggatgacaaagtcttttgtcagattgaaatgagccatgctattactgatggtgcctcttccaacattttgattaaggatctgattgacgcttatggtgataggctgtcgtcaacagaccttgtcaaaacaacacgcgaatttgctagccacttgctggctaagccacagtcccaaaagatttcgtattggaacacaaaactcaagggccttgaaccttgccgctttccatccctatcgagcatgtctcgggagaagcacgagtgtagctcggagattggagtttttgtcgaagacaagatgtttgcgcagattcaagacttctgtagcataaaccaggtcacgccagcaagtctcctcaaaagcgcctgggctttgacactctcgacctacgtacaaaatcaatctgtctgctttggctatctggcatctggtcgagacctcccaatcgccgggatggacgaatctgtcggcgcttacactaacatcatggtctgccgtgccgatttggatgggcaacagcctggtgtggcactcgtgcgacaacttcagaatcaattaatgcaggacttgagcttccaacatatatcgcttgctagcattcaacatgagcttggactggcgtccgatcagcagcttttcaactctattgtctcttttcagaggtcaggagacgataatgaacaatcagcagaggagggtaaacttcgattcaagaatattgatggtttggacccaacagaagtcagtggattgttgagcatgagagtgtatacatctggactaatgtttttatagtacgacatcgtattgggtatcaaccaaggaaccaggtccatcgaaattgaccttgaattctcacacagctgtctcactagtaatcaggcaaaacgcattctcgagcatctgcagtcaaacattgccgctattcttcacaatgagccacctgctctgatcagcccccaagatgagcaagatatttggagctggaactccactgttcctgacatggtcaacatctgcgttcacgatctgatctccaagatagtattccgccagcctgatgcaccagctgtttgctcatgggacggcgatttcacctatgcggagctggataatcttgcaacacgccttgccaatagcctcagcaagatgggcatcggaagaggcagcatcgtcccgctatgttttgaaaaatccaaatggacaccagttgccatgctagcagttatgaaaacaggtgcagcctctgttacgatggatactagccagcctgaagaacggctccagtctattgttgcacaggtggatgctaagcttgtgatttcttcgacattgaaggttgagctagcagccaggctcacaacggctcccgtcttggctatagacaaagccagcatgaaggcgatggctgacgatacgccgctggctgcagtcgatcccgcaaacagtatttacattgtcttcacatcagggagcactggcacgccaaaaggtgtcattatcactcataccaactacagcagcgccatcaagcatcagcagagtgaacacggcttcaagccaacctctagggtctttgactttgcctcttatgcgttcgatgtcagctggtccaatttcttgcacaccttgaccattggggcctgcttatgcattccttctgatgatgatcgtaaaaatgacccggcgggcgcaattgaccgcttacggtgtacacacgttgatatgaccccctcggccgcaagcgtcttacctgccagtacgttggctaaattggataccattgttctgggaggcgagaagctctcgcttgaatatgcccaacgctggtccgccctgacaagcgtgcgtaatccgtacgggccttctgaatgcacaccgacgtcgacaattacggagatcaattctgcggaaataagcaagggcaaagtgagcatcggcaaaggagtgggactcaatacttggattgttgatcctgccactgcacaacatttaatgccgattggcatccctggggagttattactcgaaggtccgcttgttggtgctggctatcttggagaccctgtcaaaaccgcttcagcatttattgaagacccagaattcctagtcaaaggcgctagtccaggaattccaggccgccgtggtcgtctgtacaggacgggcgatctagtcacctataataccgatggtagcttgtcatttgtgggccgaagggactctcaaatcaaaataaacgggcaacgcgtcgaattaggcgacatcgagtcgcacgtttctgcaaacctggtgagtcatggcagtgctcaggttgcggtcgaggttgtgtcaccccaagctagctccaacaacatacttgtcgccttcgtgagctttgacgacctgaattctatcaacctgaatgatgaaaagcttcttgcccgcacgaaagcggcgaccgagggaattagggagaaactcgcgacacaaatcccatcttatatgattccttcggtctacatccctgttactgtttttcccacaacagctactgggaagactgatcggcgccgattacgtgaaatggcctcaagcctcaccctggagcagcttacctcaatcaaccaagctcaacagcaatatcaaccccccactactcccttggaagtggcacttcgggagctctggatctcagtcctcaaattaggatcgcgaaaaattagcactacaaacaacttcttcgaacttggtggagattccatcggtgctatgaggctggtaggcgcggcccgtgaccacggactatcgctttccgttgtagatattttcaagcatcctaagttcagcgaaatggctgctttgcttcgttctgtggataagccgcagttggaagagccacgggtatttcaacccacttcgcttctgtccaaagatcacaacaaagaccagatactctctcgactctttgactttggtattgacttggaaaatgttgaagacatcctccctgtcacggatcatcaagctcgttccatcgcgatgactcactctgcgtcccgcgacttgctactctatcacactttagatagcaagggcgtgccaaatatgcgcaagatgcgagcagtgtgcaatgagctcgtcaatagatatgatctcatgcgaacccttttcatcgcacataaagacagcttcttgcaggtcgtgctgaaggcctttcctgtggatataaccgtcttgagaattgagaatgccagcctagaggaatgcacagaagagctacgattacgcgacagggacgatgagctccgttatggctcgctcctaacaaagattgctattttgcatcaaatccgcgacaacgaataccgtcttgtggtccgcatttcccatgctcaacatgacggaatgagcttgatgaaaatgtggaacgcatttgaagaaatgtacggtgacgggagtgacgactcattccacattccttcggacactagcttccaagaaaagtctaaggctagtttctccaactacatgcatgccgtggctggtacaaaccgggagcaagctaagtctcactggcgcagactcctcaagggctctagcatgacgaacctcaagccccatgcttcatatgccctgacctttggcgaaggaccatgtgtcgccagacatgttcctaagagcattgctcaaggtactggatttacatttcatactgtactgaaggctgcttgggcgtacgttctggcaaaacaccttgccaacgacgacgtggttttctgtagcctcactcacggtcggggcttgcccgggacacaagatgtctttggagactgcgtgaacatcattcctactcgagtatcttttaccgacggatggactgttcgcgaccttctcagtgcattgaacacccaacagattgcgagcatggagcatgagaatataggcacacgcgaaattgtccgtgactgtactacatggccgaagtggacatatgcaggatccatcgtttatcaccatgactttgacgatggagaacatattgctcataaccgcagtatgcacgttgagcaggagctaaatctgtctcacggcaaagtggacatgaccgacgttcatatcacttctaagcctgataacaacatgttccgaattgagctggacttcgcacatggcgtggtgtctgagcgtgacgctgaactgctagctgcgaaactgacggagtctatcatcgttttctgcaatgtcatggaccagcctttgttatctcccgacgagatcagatatctgcggacaaccacattgctgccctcagaggagcctctcagtgcaaccccaacaaatgaacagttaatggttgctagcattagcccgactgaaatgcaatgggcgcttgagagtgcgtggaaggacactttcaattgcccccttagtcctgaggtgaaagcgggcaagacaatttttgatcttggtggtgacttgataagcgctagtctgatatcagctcacatggagaggcaaggatatgtccttagtgttgaggatgtcttggggaatccgacgtggttctcgcaactgacgctgttgacgaagcgcactcttcgggatgttgatgtctgatgaacaagaatgtttaatatttagtctgtcattcctatttggtatcatcactcagtacttcggcgtttctttttttttttttttacacaatatttcatgttttgaaatcgatcaactttgaacctgttgactcatatgcccgtactagtactaatcttcgatctcattttcaagtttgaccttctggcacatacatactctgttctagtagcttccttggctctaaagttcactggcagacattggtcaatgtcttcaagttattgatagtagatgcaatacgcaggtgattgaaaattcaattaaaaaaataaaaaaataaaaaactaaaaataacgttcattcctcatagctgattgtcaaatgcctacagatctactaacttagtaaaataaagattaaggaggattattaaatataaaatattgagatccaggcagttcagctgagtttcagataaagaagaataaatagaatgaaatgaaagtagtaaaagaactatatctaaaatcaagaaaaacaggtgaatactaatatataacagaatagatttgctggtagttatccgtccaactactaacctcctggcgtgtggattgagtacagctgagcagacagtcatatgtacttactatttatttacacaggaagtatataatggatgactcaatatcgagttcaagccggattcaaccgaatcttaatcaaattcttatacctgtccaggccagtacgcactatctatgcacagaccaagcattctgcagcagagtcatcactttatataagcagtgaaacagcctcaagtgtgtgagtgaaagtgtagtaaggttcaaggagtattacctccaataggggtcagtgtgatgcaatatagcggccttgccgggaaaaccatccggactgacgtttaaccttgactcgactgactctcactgaagattcactcccatcctgtgtatttgagcttctcactattctcacctttagcatctctttactttacaatatattcactatatctaccatcatgacttcattcattggtaacctcatggccgctataggctttcccagcactcgcaggggttactctaggctttcacaaaccgcagatttaccaccaaagccagacttaccaccgctcctccgccttcctcctcaccttcttggaaagatcctgcggcttttacctcttccatctcgggcttgtctagttttaacatgccaggaactctaccaaacttacaagccaataattgaagatcgccgactccagtttccctgtttgttaagaaacctcaatcccactatcagtcttgaccaagctacggtacctcgtaacatatttctgcatcagctccagaatgaaaagtgggctttctgcaacgcatgcctcaagctacacccatggacccaattaaaggatgataatacctgccactcacgagccgggatcgttggcctctgtccctgtatcagtctcacgcatcgagacaagacccgtctgttccgaactttcttctcgaaaacaaatgtttttacaccacccaaacaggacccacgatttgagctgctgtgggaagggaatccacgcttcccgccagagttggtcggaaagtgccgttgtgtacaggtacaccactgcagggtaatcttctacccagatgtccggattgatataaaagttcaggtatactatggagctgagcatcaacagtggattcttctggcgcaaacagactataaggttgccttacattcctggcctcgcccggcttcaatagagccatatttcgcatgtccccaccagagtttactttcttgggcgtttcatccatctcagaaagatactgactgcgtagtctgcggctcgcggtttcggctgaggcgtacgcctcaggctgatgctggagagcgggatttgtttgtgtataggaacctgggaggagtgaagtggccgccagatgtagcttggcaggaccaatgtcggcttcgag

SEQ ID NO: 12 - DNA, 21108 bp, Aspergillus niger
atgcgatctcccaatgatcttacaacatcagcaaccatggaagatattcatcaaatatggtcttggaacgctaacgtgcctgaggcgggtgagacatgcgttcacaccctcatcaccgacaaagctctccagcagccagatgcacttgccgtcgacgcttgggacgggaggtggacgtatggtgagcttgagactacttctaccaaactggcattgcgtttgcttgaccttggagttggccctggaaccaatgttgtcatatgttttgaaaagtcgaagtatacgcctctggctatgctggccgtcatgaaggcgggtggagcctccattgcgctcgatacaagccaaccacagacacggttacagtctatcatcaaccaggtcgaccctgtagtgatactatgctccgcgtccaagagtcagttggccaagtcaatcatcaccgagtctgcagtagcattgacaattgatgaaaattctctatccgaaatgaatttcgagccggactcagtcgcccgtctccctgacgtcagtctggacaacaatctctacgtggtctttacctccggaagtacaggaactcccaagggcgtcgtcgtcacacatctcaattactccactgccattctccaccaacaagaagcgcatggcttcaagtctacttcaagagtgtatgactttgcttcgtatgcttttgatgtgagttggtcaaatctcatccacaccctcaccatcggcgcctgtctgtgtattccatcagagcaggaccgtaaggacaatctcatcgagtccatacgctcactgtgtgctacacatatcgatgtgaccccgtctgttgctcgccttatccctgattccttgctctgcaagattgaaacacttgttttaggtggcgaaaagctgcctgcagagcttgccagacatttgtcatcgctggtaacattgaaaaatccgtatggaccgagtgaatgtacgcctacatcaactatcgctacaattcgaccggatgatgatgattcaaaaattagcagcattggccgaggcttgggtgtcaacacctgggttgtagacagtgagaatgaagaaattttggtgcctattggacaggttggagagctattacttgaagggcatctgcttggcaatggctacttgaacgaccagacgaagaccactgcggcctttgtcaacaatccgctttttctgctcaatggcggcgatggacctgggcagcctgggaggcgcgggcgtctctacaagaccggcgacctggtccgttacgagaaagacggtagcttgacatttattggccgtaaggacacgcaagtcaagattaacggccaacgagttgagctgggtgatattgagcatcatatttaccgccacatcccacatggcaccgtgtctgtgcgacaaattgcagcagaaattatttcaccaaagactggttccaatgctgtcctggcagcatttctcgaggtcgaccttggtgtagaggatacgggaatagcggaacagttgttttcaaaaaccgagaagatgatgtctaacttgagaagcaatcttgctcgagatgtcccttcatatatggttcctgctgtattcattccgttgaggaacttcccattgtctccgacaggcaagacagaccgacgccaactgcgggccattggtgaatcaatggacttgactgtcttggcaggctttggcgcagcacctaatgaggctcggatccctctcactctgcgagagaaacagttgagaagactctggggctctatcctcaggattgacgaaaaccttattgctctcgacgataactttttgcaaagagccggcaacccaaatgcagccatgaaactcgtcactgcagctcgaagagaaggcttctccctgagcgtggccaacgtgctgaagtatccgcgacttcaggacatggcacaggtggttggaacagtggagcaagagcaggcacatgaaattatgccatttgagcttctgagcgatgatattaatcttgatctagccctcagagaggctgcagcatcgtgcaacgtacaagggaatcaaattcaagacatttatccctgcacaccgctacaggaaggcatgatgtccctatccgcaaaacgcgagggtgattacatcatgcagtatacgctggagctacaccatcgatgcgacatagagcgcctaggtaaagcctgggcgacagtagttgctacgacgcccattttgagaacacgaattgtcgacatcactagccaggggttggtacaggctgttctagacgagcagtggtcaagttcgtcgatccaaaggaggaccttgagccaggcgagagaccacaagcatcaattcgggctaggcatgccattaggcagatttgaaattgtcaccggcgactcgtctgattttaagcactacttcgtctggacactgcaccatgccctgtatgacgggtggtcacttcagcttttactcgaaaagctcgagaacgagtacgccggaaaggcagacgcgcagtcaaactcacccgattttaaacgttttatcaagtatatttcaacgagggatggcgagaagactcattcgttctggaccgaacagttccaagacgtcgaagcccagatctttccgagtttgccatctgtcgactaccagcctagatcggacaaactgtacactcattctgtgggaggaatacaatggccaaaaaatggaatcaccccatcgacgacaattcgtgcggcttactctatcttgatatccagtctgaccaacagcccagatgttgtcttcggcagcataacgacgggcagacaagccgccgtggatgaggttgaagagcttattgcaccaactatagccactgtacctgtgcgcgtttcgatcgacagcaaagacgagttgggacagttcttacagcgaattcaatctcaggccgcagatatgattgagtttgagcagactgggctgcatcagattcgacatatcaatgcagatgcggagcgagcatgccagtttcagacactgcttgttgttcagcccgcggagggctcgggcacagcaccgagcgacatttttaccaacattcccgacgacataaggaaaggagatggaaacagcgccgcagagctggggacttatgccttgactatggagtgtctgctcaagaaagatggccttgacctccatatgaactattgttccgcagtcatatcggagcatcaagtgcgccgtttgtcacagcagtttgagcatgtccttggtcaaatatgtcatctgacgatgataattcacagacagagaacaacacttgaatcgctgcggcagccaacaacggaaactgagcggcagatgcagcgaatctgggcacaggtactcaaccttaatcaagcatcaattgggctagattacagctttttccaactcggcggcgactctattgctgccatggaagttgtgacagaagctcgtaagcttggcttgaaactggctgtgtcagacatattccgtcgcccgaaattgcaagacgttgcaaagaaggcttgtgacagtggcctgcagctttatggagaagagcagctcatgaacgactcagaagtccaagttaaaggaggtaccgagcacactaagctacccaatgatgacaaggcagttgctggccatgaaacgcagcaagtcatggtatgggagggaatgttcgataaggaggtctatggaactattaatgatgtccaattggagaagattgggcgcgacttcatcggatggacgtccatgtacaatggcaaccaaatagacaatgtcgaattgaacgagtggctagacgatactattgccacaatacgcagcagcggatcgacagccaacatactcgagctggggtccggcagtggaatgatcttgttcaatcttgtcaacggcctgcacagttatgttggacttgacccgtcagaaaaggccgtggacttcgtttgttccacagttaaatccattccccagttggccgaccgtgtctataatataaagggaacagcagacaacatcaacagcctaggcgtacccatctctgctaacatggtcatcgtgaactctgtcgtccagtactttcccagtcaagactatctgctcaaagtaattgaggacctagttcagctggaaacagtccgcacgatctttttcggcgacattcgctcctacgcgctgtttcgagagttccaggttaccagggcgctgcatattgcaggagatactgcaaccgaggacgagatccgacagatgatggccaacatggagcaagtcgagctggagttgctggtagatcccgcttttttcacatccttagtcgaccggttccctggactcgtcgaacatgtggagattcttccaaaaagattgaagtcgacgaatgagctgagtgcctatcgatacgctgccgtcgtgcatctcaaagactcaaaccaactagctcagccattacaagtccacgatatccagaaagagagctggattaactattccgggcgtcaactcaatcgtcagtcgctgttacaacttgtacaggattctttcttacgagacccgtccccctcatcagttgtggccgtatgcaatataccttatagcatgacagtctacgagaggcacgtgattgaatggcttgatagtggcctcactgccggtcccgatgctgaggactggctctcttctatccgccaaacatcacaagaatgctcatcactctcggctctcgatctgcaacaaatagctcaccagacaggatggcaagtggagattagctggagtcggcaattttctcagcgcggtggcttggatgccatattccaccgacaccattcacgaggagaccgaaccagcagggctttgttcaacttccccacagattatcaaggacggccatctcaatcgttgagcaattggcctttgcagcgcaagcgacagggagaggaaaagcaaataactttgggagatgtttctaccgtctgcaaagaggacttgcatgacatctggacttggaatgaagttgtcccagacgccctcgaggcctgtgtccacgatctcatctcggacacagtaagagctcagcctcaatcccctgctatttgtgcttgggatggtgagtggagttacatcgagcttgatgatttgtctagccgtcttgcacacgcgcttgctccgtttggcgttgccaacacagttgtacctatatgctttgaaaagtcaaaatggacaccagtggcaacgctggctgtgatgaaggccggggcagcgtcagtcaccctcgatgcctctcagcctctggagagattacggtcgattatctcccagactgaccctcgagtgatcttgtcatcggcgtctaagcagggcttgggtgcccaactcactaaagctccaaaccttgttgttgaccaacattccatttctactatgcacatcaccgccgagcctcttcccaccgttgacccctccagcaagctatatattgttttcacatctggcaccacgggtgttcctaagggcgttattatcacacactctaactttagcagtgccatccgacaccaacaaaaagctcatggtttcaaatcgacatctcggatttatgactttgcctcatacgcgtttgacgttagctggtctaacttcatacatgcacttactgttggtgcctgcttgtgtattccgtcagatgaggaccgccgtgatgacttggccgggtcgttggagaggttcggcgctacccatgttgacatgacgccttccgcagcaagcttgctcccagagaagtcattcaaaaggcttgagacggttgtactcggaggcgagaagctttctgtcgagagcgcacagcgctggagctcactagtcagcctcaagaacccatacggtcccagtgaatgcacgcccacggctaccattgcgacggtaacacccaccgatgagtacaaatccagtattggaagaggactaggtctgaatacatggattgtaaatactgttacagactctttagttccagtcggcggggtcggagagctcctgctcgaggggcctctcgttggcgcagggtacctcggcgatgacacgaagacggccgcttcctttgtggaagatcctcagttcctattgcaaatatgccctcaaggtcaagcaagacataccagaatgtataagactggcgatctggttcattacaacccggacggaagtcttagtttcgttgggcgcaaggacgctcaggtcaagattcatggtcagcgtgtcgagttgaccgagattgagagccatattcgtcgcacctctaagactatccaggtggctgttttgtttaccaagtcagggctgtgtgcaaatagggtagttgcatttgtctgcatccagggaactggccaaactcagacagccgccgatcaaattcgactcatcgatcccaagtattcgacccttgttacggcttacaccgagtccgcaaagtctagtctcagcgacactcttcctgcttatatgatcccctcaatttggattccactccagcatgttccgttgtcaacgtccggaaagctcgattacaaagctttgaaatcatggcttgatagcatggatgccaagacgtttgccaatattttatatgcgtctgatggcgacgtgaagcttcgcaaggctgagacagaattggaacaggtcatagtagaggcttgcgctaaaattctcaacattacagcatcgaaggtgaacctggatcggtcgttcattgcgaatggtggtgattccatctccgccatgaggctcgttgctcattgtcgcgcggacaacgtcgtattttcggtggctaaattgctaaagagcaaaactttggccgctttggcctcatcttcaaaaatcaagtcagcttccaacgtgttgggcttctatgaggaaaaaagtgactcttttgcgttgtcgccgatccaacagtggttctttgaacaaggtctctacaagagatccaatgacaacttcgacaatcaaggattttatctcaaggttaagcgcccattattgacaaaggatattgactcggcgatttccaaagttgttcagcatcactctatgttgagagctcgctttcatcggaacggcgacgagtggacccaaaaaacgcttaagcctgacaccaatggtttatatcactttggtgtccaccacacgtgccttccagctgatatagagcgactagctctatcacgccaccagatgatcgacatcgaaaaggggccagtattctctgctgacatttgccataatgcgtttggagaacagtacctgatcctgattgctcaccatcttgttgttgatttagtctcgtggcgtgtcatcctggaggacatagaatctctactcggtggtagtaatttgcaaccaagtcttccatttcaagtctggaatgatatgcaaattgagcgggcgaaggaatcgagcctacttgatcctgaaaatgttctatcaaccactggaattaataacaacctcgatttctggcaagccacagcagaaaccaagaacaccgtcgaagatcacctaaatttctgtaccaagatcgacagcagcattacagagctcatcctcaaagacgcaaattacccgttcaacactgaacctgtggacctccttcttgcggctgtttggcatgcattcttcaagacgttcccccaaagagacggtctcactatttttattgaaggacatggtcgcgagccgtggtcctcggatattgatctttcccgcactgtcggttggtttactaccatcagccccattcatgtgtcaaagagcgacgtacacaagtctgtcgcaagtctagtacgcgttgtcaaagatgctcggcggctcctgcctgcaaatggctgggcttactttgcttctcgatatttcaatgaatcgggaaaatcagcgttcaaatcgcacgactctattatggaaataacctttaactatcacggccaatttcaacagctggagaacgagaaggcgatgtttgaaaatgttacgctcagtggagtctgcgagcaaggaccagctcttcccgcctcttccttgattgctgtcgaagtctcgatagatcgagggcaggtcaccttcgacgtttctgccaaccgctacattaatcaccaggattgtatttcaaattggatcaaagcaatttcacagtcattggagaccatttccaatgagcttgtgtctacagaaatctcacatcgcacgctttgcgactacgaatttctgagcctcgggtatacggagctggatcgattacaggaaagtgtcatcccagaaattgagaagctaaataattccacagtagaatgcatttaccgctgtcttcccacagttgatggtattctgatcagccagttcaaagacccagaatcgtataaaacagtgcaacatttcgagattacttcccacatcgacgaccaaatcgacctagagcatctttctctagcatggcaaaaagtggttgccaatcaacctgctctacgaaccgtctttatccctggcatggacaaagccgctgcattcaatcaagttgtgctgtctcagtaccacgccgagctcatcatcctgcatactgccagcgacgagtacaccgaagccttggagatgttcaagaatttaatcccaatcaattatcagagcttcaagccacctcatagagccgcgatctgtcgaatctcacctagtagagtactctgccaggttgagatgagtcatgccatcacagacggtgcatcgacatctattttggccaatgatcttctccaggcatacaacggcaactcgatgccaataaatctcatggacacagcatgtgagtttgctcgggcccaactcacttcctcttttggggaaaaactgtcatactggaagaaaaagctttcgggaatggatccctgccacttccccaaaatctcgggtgcttcaacacaaggcaccggtacatccgtctgcaaaattcgtggcgctctgtttagcaaaatccaggattattgcaattcagtagaagtcacgacggccagtttatttcagaccatatgggcacttactctggccgcctataccggcaacgactcgacatgctttgggtatctagcatctggccgcgacttgcctattgctggcatcgataaatctatcggtgcattcacaaacatgttgactgttcatgatcaagttatgcaagatctggagcaccagcactgctcactagcaagcatccagcatgaactaggcataaattccgataaccctcttttcaactccatcctatcatatcagaagcaggacgatgagccggcagagacgaggtacgacattgtgttgaatattgggcacgctaccgaccacatcgaaattgtttttgactataaacacgcctgcctttcaagcatccaggcagagagcgtactttcactcatgcaatctacagctgccgctctagttcagcatgcttcgggagatcatcagactttaagaagcgtcaacatggttagcactgaagatatatctgacatatggcaatggaactcagacgttccagtcactgtcgacgattgtgtgcatcatatcattacgcgaacttgtcataaacgcccccaagctccggcaatctgtgcatgggatggcgattggacctatgctgaagtcaataagctgtcagataaacttgcccaccttctagtctcctatggtgttggccctggagtggttgtcccgctttgcttcgaaaagtcaaagtggacacccatagcaatgatggctgtcatgaaggcaggaggcgcatctgttgccatggactcaacccaaccagaggaacgcctacgagcaatcgtaaaccaagtgaagtcacctattatcttgtcatcatttgccaacgaacagcttgcaagccgactaatcagcgagcttcccagccccaccaaggtcctcacaataagcgacaaagaagtggaaaatttgaatgttccgagtggaagccaacttcctcatgtcaaccccagtgatactctctatgtggtattcacatccggtagtacaggggtgccaaagggagtggcagttactcactccaacattgccagtgcgatcaaacaccagcgacacttgcttggattcacttctgaatctagggtattcgacttttcttcctatatgtttgatgttgtctggtgcaacttactacagggtctttctgctggaagctgcgtttgcatcccgagcgacaatgaaaggaagactgactttatggccgctattgttaagatgagggcaaaccttgtcatattgacaccttctgctatccgcggcctgaagcttgacgctctgaacagcctatgcaacgtccacttcatcggcgaacctttacatgttgacacttttagatcagttgacgaaagtgtcacgatatccaacctatatggccccactgaatgtacaacattcagcacagtacaaaccatctgcggcagacagcatcagtcaatcacaattggcaagggagcgggtctgaatacctgggtcgcggacatagccactggtacggctcttgtaccaattggcagtgcgggagagcttctacttgaaggcccattagtcgccgccggctaccggggtgatgctgtcaaaaccgctgccgcattcgtatatgacccgccatttcttctgcgtggatcggtgggccaccctggtagacgtggccgcctatacaaaaccggagatattgttcggtataactccaacggtactttgactttccttggccgaaaggattcgcaagtcaagatcaacggacagcgagttgagttcggtgatattgagtctcacataaacggggcgctgctaccggacttcagtgaaggtcaagctttagtcgactttgtaacacctcaaggaagctcacgtccaatgcttgtagcttttgtttacttcggacctactgtcactgagggcatggatgaggccgatctgctaagcctagccaagcgcacagccatatcgctggatgagagtcttgctgctcgaatccctgcattcatgataccatctgcttatattccattgcagaaaattcctgtcacagcgacaggcaagacagaccgccgtcgtttacgcgagatggccaaagatgttacctgggaccagctcattaaagctgactcccacggtcctgatcgttgtcaacctggcacagagatggagatacagctgcagatcctatgggggactgtgctaggagttgaaagtagtttgatcggtgcacatgacaacttcatgcgcgtcggtggtgattccgtgggcgcaatacgcttagcgagttctgcccgggaacttggtttcacgctgaacgtggctgatattctcaagaacccgaaactaagtgatatggcaaaacttatgatacgaacagagccgtcgcaggatatttcaatcaaggaattctctctcctcaaacctggctctgatgtcaactgggctgttgcagagacatccgctttatgtggcgtggacggtaaccaagttgaagatttatatccttgcacacccctgcaagagggcttgctggcgctgacaacaaagcgccccggcgactatatcatccggtgcattttggaactgaagagatcaacagacgtcaaaaagttctgcgcctcttgggaggcggtgttggagagcaccccaatactacgaactcggatcgtagacatcgcggaacaaggtttggtgcaagctgtcatcaagcaaccagcacagtggacatcggcagaagcctccagtttggtcgacttcgtggctgctgataatgagaagacaactggtctgggtatgcccttggtgcgattcggactagtacaagagacgaacaaacacttttttgttttgactctgcatcatgcagtatatgatggctgggcgctgaatctggtcttcgaaaagctcgaaaatttttatgctgggtcttccaggcatgaaagcccggatttcagacacttcgtcaagcacatttcaagtctcgacaacgacgcggctgccaagttttggaaagaccaactccaaggctcagaggcacccacttttccctccttaccaactgccacgttcgtgcccaagtctgaaaagaccattttgcacacagttgaagagttgcagtggcccaagactaatgtcactgcttttacgttggtgcgtgcggcactgtcacttttaacggcggcctacaccaattcagaagacgtttgctttggcgtgacttccaacggtcggcaggttgggctccctggagtagaaagaatgataggcccgactattgcgacagtgccagttcgtgttcgcattgaccgcgagcagcgtctccaagccttcctcacacagatgcagcatcagtccattgacatgatagcgtttgaacaatttggtctgcagcaaatacggaagtcaagtcctgacgccgaacgggcctgtaacttccagtcacttctcattgtccagccggcagaagagacagcccagtggcagagcgatataattgcccgtgatatcggagaaggagctgatgatcctatgggcattcaagaaattggaacatatgcccttactctcgaatgccatctcggacccgacagtttgctcataaaggccaactttgattccaatgtaatcgatgaactacaggtcaagcgatttacaaagcagtttgagcacgtgcttcgtcaaatatgctgctctggtagtggccttgtcgtttctgatattgataccaccagcagacaagacatggaagatatttggaagtggaatgccgtagtcccccagtcagtcaacacgcctgttcatgagctcatctcctctgtggcacgcagactgccgcatgtccaagctgtatgcgcatgggacggcaactggacttaccgtcaactggatgacctgtcaaattatgttgcgcaccacctcgtcgaccttggtgttggctctcaggacatcgtaccgctgttgttcgagaagtccaagtggatgccgatcgcgatgcttggtgtcatgaaagcaggggctgcgtcggtggctgtcgataccagtcagcccaaagaccgacttcgcatgattatcgaccaggcaaatcccacggtcgcgctaagctcagctgataagttgcctcttgtccggagtctgacaaaggcgcaaagcttcgttgtcagtggccaaggtattgaccgcttattaaaacctagccttaatgctacacttccagttgtcgatccgtccagcagactgtatttggtcttcacctctggtagtacgggtgtcccgaagggtgttataattcgacattgcaattttgccagtgcaattaaacaccagaaagaagttcaaggcatccttccaacctcgcgtgtctatgattttgcttcatatgcatttgacgtcgcatgggccaatgcgctactgacctttgagagcggcgcttgtctctgtatcccatccgatgctgacagaaagaatgatctaaacggttcgattgcgcgactgaagccaactcacgctgatcttacgccttcggcagcactggtcctgtccaaagagtcacttcagcagcttgataccctcactttaggtggcgaacgtctcctagcggagtacgcaacaaagtggtcccagtttgtgacagttaaaaactcatacggaccaagcgagtgcactccaactgccacatttaccgaggcaattgggcgtggatacgatcttggtgctagcattggtaagcctgctggtctcaacacttgggtggttgatcctgtgacggggcagtcgctcgttcccattggaggcgtcggcgagctgttcttggaggggccgcttgtcggtgctggctatcttgatgatgcagagaaaacgaatgctgcttttatccatgatccaccatttttgctccgcggcaacgttgtcgcgcaacctggacgacgcggcacgctgtacaagacgggtgacattgtgcgatacaactcagatggcagtctcacttttgtttgtcggaaagatacacaagtcaagatcaatggccagagagtagagcttgctgagattgagagtcatatagctctatacacagcgacccgacaagtggcgaccctattgcctagcactggcctctgtgcaaacaagctggtagctatgatcagcctcacagatgtgaactatgatgttagcgaggacctcgccgaaaacaagattgagctggcatcttcggaacatgaccaactcatcaatgagcacatcgaggcccttcaatcgttattgcgcgagtctttgccgcagtacatgattccatctctgtgggtggtcttgtacaacctccctatgacagcatcgggaaagcaagacaataaggcactcaaatcctggctggaaaatatggatgaaacgctcttttctaaaatcaacaatgcgaacggtagcgacattatccgaaaaccagacacagaagacgaaagagtcctcagccagaaatgcagtattgtccttaatatgcccgtcgacaagatcaatctcgacaaatcttttattgcgaatggtggagattccatttccgccatgaggcttgcatcccactacagaactgtgggaatttccatctcagtctcaacactccttcaaagtaaaaccctcgcggatttcgcagcattttcgggcgcaacagccattagcggagtcagtcaggaagagcatactgacgttcctttcgaactatcacccatccagcagtggttctttgaccaatcgccatttatgagccagcagaagcatgacagattctacaaccaaggattctatgtgagactcaggcgcacagtgagaatcaatgatctagaatcagcctttctttctctggtcaatcgccacgcgatgttacgctcgcgatttcagcatcatgggggcaaatggaagcaaataatcctcagtcacagcaaacgagctcttcatttgaacgtatcgcagcacctgtccatgagcgagattgcatcgttagctcaagagcggcaccgacagattgacatagagaaaggtcctgtcttctcggttgatatttgcttactaggccagcagcagcatctggtcatgatagcccatcatttggttaccgacttggtctcctggcggattatcttagatgatctggagactattctcaacggccattccctaacggccgctctacccttccaagtgtggagcaggctgcaagctgagcgggctgtatcttccactttgaagcctcacaacttgctgtcgactgacggcgtccataacaatctcaagttttggaagtatacgcacgacacgcccaactgcttggcagaccacaggctccgatcggtcactattgatcgagaaactacggctgtactactgggcgaggcaaacaatgccatgaatacagagccagtagagatccttttatcagctgtttgggatgcattctttcggacgttttcccagcgcaacagcctgaccatattcaacgaaggtcatggtcgcgaagcttggtccgatgaaattgacttgtcgagcactgttggatggtttaccacactcagtcccatcaacatctatagaaataatgccaccagcgagaccgacatggtgcggctcgtcaaggatgcccgccgcagccttcccgcgaacggctggtcttactttacctcccgatatctgaaccccgacgggcaaagagcttttgaaagccataacacggtgtctgaagttgttttcaattatcatggccaattccaacaactagaaagtcatcaagccctttttgaagacattgatcttgtcggtgtacgtgtgcaaggtcgctcaatatctgcagggtctttgtttaacatcgaggttgccattgaagcaatgcaagcgcactttgaattctccgttaatcaaaatatcgctcatcagagcttgattaaccagtggattgaccaaattcaaccctctttggaaaggatttgcctcgtccttctcgaggccaacccaacgcatacgctgtgtgacttcaagttcatcagtctcgactaccagcgccttgacgatcttaccagtcgactacttccggagatcgagtcaatcaaccaatcaactgttgaggagattttctcgtgctctccgattgtcgatggaatgctcctcagtcagataaagcagccagaatcatacaagacacttcagcgatacgaggtgttgtcatctcatgaccatcctatctgtctcgacaccctcaaaattgcttggcaaagggtgatttctcgccagcctgccttgaggacagttttcatcgctggccttgacggatctaccgccttttaccaggcccttctcaaacagtgctccggggatgttatcgttgttgaggctaaaactgaagaggaagccctgaaagccttttcctcgcttccgaaagtcgattaccaacaggccaaacctcctcatcgcctcactctttgtcaaacgccggatgacaaagtcttttgtcagattgaaatgagccatgctattactgatggtgcctcttccaacattttgattaaggatctgattgacgcttatggtgataggctgtcgtcaacagaccttgtcaaaacaacacgcgaatttgctagccacttgctggctaagccacagtcccaaaagatttcgtattggaacacaaaactcaagggccttgaaccttgccgctttccatccctatcgagcatgtctcgggagaagcacgagtgtagctcggagattggagtttttgtcgaagacaagatgtttgcgcagattcaagacttctgtagcataaaccaggtcacgccagcaagtctcctcaaaagcgcctgggctttgacactctcgacctacgtacaaaatcaatctgtctgctttggctatctggcatctggtcgagacctcccaatcgccgggatggacgaatctgtcggcgcttacactaacatcatggtctgccgtgccgatttggatgggcaacagcctggtgtggcactcgtgcgacaacttcagaatcaattaatgcaggacttgagcttccaacatatatcgcttgctagcattcaacatgagcttggactggcgtccgatcagcagcttttcaactctattgtctcttttcagaggtcaggagacgataatgaacaatcagcagaggagggtaaacttcgattcaagaatattgatggtttggacccaacagaatacgacatcgtattgggtatcaaccaaggaaccaggtccatcgaaattgaccttgaattctcacacagctgtctcactagtaatcaggcaaaacgcattctcgagcatctgcagtcaaacattgccgctattcttcacaatgagccacctgctctgatcagcccccaagatgagcaagatatttggagctggaactccactgttcctgacatggtcaacatctgcgttcacgatctgatctccaagatagtattccgccagcctgatgcaccagctgtttgctcatgggacggcgatttcacctatgcggagctggataatcttgcaacacgccttgccaatagcctcagcaagatgggcatcggaagaggcagcatcgtcccgctatgttttgaaaaatccaaatggacaccagttgccatgctagcagttatgaaaacaggtgcagcctctgttacgatggatactagccagcctgaagaacggctccagtctattgttgcacaggtggatgctaagcttgtgatttcttcgacattgaaggttgagctagcagccaggctcacaacggctcccgtcttggctatagacaaagccagcatgaaggcgatggctgacgatacgccgctggctgcagtcgatcccgcaaacagtatttacattgtcttcacatcagggagcactggcacgccaaaaggtgtcattatcactcataccaactacagcagcgccatcaagcatcagcagagtgaacacggcttcaagccaacctctagggtctttgactttgcctcttatgcgttcgatgtcagctggtccaatttcttgcacaccttgaccattggggcctgcttatgcattccttctgatgatgatcgtaaaaatgacccggcgggcgcaattgaccgcttacggtgtacacacgttgatatgaccccctcggccgcaagcgtcttacctgccagtacgttggctaaattggataccattgttctgggaggcgagaagctctcgcttgaatatgcccaacgctggtccgccctgacaagcgtgcgtaatccgtacgggccttctgaatgcacaccgacgtcgacaattacggagatcaattctgcggaaataagcaagggcaaagtgagcatcggcaaaggagtgggactcaatacttggattgttgatcctgccactgcacaacatttaatgccgattggcatccctggggagttattactcgaaggtccgcttgttggtgctggctatcttggagaccctgtcaaaaccgcttcagcatttattgaagacccagaattcctagtcaaaggcgctagtccaggaattccaggccgccgtggtcgtctgtacaggacgggcgatctagtcacctataataccgatggtagcttgtcatttgtgggccgaagggactctcaaatcaaaataaacgggcaacgcgtcgaattaggcgacatcgagtcgcacgtttctgcaaacctggtgagtcatggcagtgctcaggttgcggtcgaggttgtgtcaccccaagctagctccaacaacatacttgtcgccttcgtgagctttgacgacctgaattctatcaacctgaatgatgaaaagcttcttgcccgcacgaaagcggcgaccgagggaattagggagaaactcgcgacacaaatcccatcttatatgattccttcggtctacatccctgttactgtttttcccacaacagctactgggaagactgatcggcgccgattacgtgaaatggcctcaagcctcaccctggagcagcttacctcaatcaaccaagctcaacagcaatatcaaccccccactactcccttggaagtggcacttcgggagctctggatctcagtcctcaaattaggatcgcgaaaaattagcactacaaacaacttcttcgaacttggtggagattccatcggtgctatgaggctggtaggcgcggcccgtgaccacggactatcgctttccgttgtagatattttcaagcatcctaagttcagcgaaatggctgctttgcttcgttctgtggataagccgcagttggaagagccacgggtatttcaacccacttcgcttctgtccaaagatcacaacaaagaccagatactctctcgactctttgactttggtattgacttggaaaatgttgaagacatcctccctgtcacggatcatcaagctcgttccatcgcgatgactcactctgcgtcccgcgacttgctactctatcacactttagatagcaagggcgtgccaaatatgcgcaagatgcgagcagtgtgcaatgagctcgtcaatagatatgatctcatgcgaacccttttcatcgcacataaagacagcttcttgcaggtcgtgctgaaggcctttcctgtggatataaccgtcttgagaattgagaatgccagcctagaggaatgcacagaagagctacgattacgcgacagggacgatgagctccgttatggctcgctcctaacaaagattgctattttgcatcaaatccgcgacaacgaataccgtcttgtggtccgcatttcccatgctcaacatgacggaatgagcttgatgaaaatgtggaacgcatttgaagaaatgtacggtgacgggagtgacgactcattccacattccttcggacactagcttccaagaaaagtctaaggctagtttctccaactacatgcatgccgtggctggtacaaaccgggagcaagctaagtctcactggcgcagactcctcaagggctctagcatgacgaacctcaagccccatgcttcatatgccctgacctttggcgaaggaccatgtgtcgccagacatgttcctaagagcattgctcaaggtactggatttacatttcatactgtactgaaggctgcttgggcgtacgttctggcaaaacaccttgccaacgacgacgtggttttctgtagcctcactcacggtcggggcttgcccgggacacaagatgtctttggagactgcgtgaacatcattcctactcgagtatcttttaccgacggatggactgttcgcgaccttctcagtgcattgaacacccaacagattgcgagcatggagcatgagaatataggcacacgcgaaattgtccgtgactgtactacatggccgaagtggacatatgcaggatccatcgtttatcaccatgactttgacgatggagaacatattgctcataaccgcagtatgcacgttgagcaggagctaaatctgtctcacggcaaagtggacatgaccgacgttcatatcacttctaagcctgataacaacatgttccgaattgagctggacttcgcacatggcgtggtgtctgagcgtgacgctgaactgctagctgcgaaactgacggagtctatcatcgttttctgcaatgtcatggaccagcctttgttatctcccgacgagatcagatatctgcggacaaccacattgctgccctcagaggagcctctcagtgcaaccccaacaaatgaacagttaatggttgctagcattagcccgactgaaatgcaatgggcgcttgagagtgcgtggaaggacactttcaattgcccccttagtcctgaggtgaaagcgggcaagacaatttttgatcttggtggtgacttgataagcgctagtctgatatcagctcacatggagaggcaaggatatgtccttagtgttgaggatgtcttggggaatccgacgtggttctcgcaactgacgctgttgacgaagcgcactcttcgggatgttgatgtctga

SEQ ID NO: 13 - RNA, 21108 nt, Aspergillus niger
augcgaucucccaaugaucuuacaacaucagcaaccauggaagauauucaucaaauauggucuuggaacgcuaacgugccugaggcgggugagacaugcguucacacccucaucaccgacaaagcucuccagcagccagaugcacuugccgucgacgcuugggacgggagguggacguauggugagcuugagacuacuucuaccaaacuggcauugcguuugcuugaccuuggaguuggcccuggaaccaauguugucauauguuuugaaaagucgaaguauacgccucuggcuaugcuggccgucaugaaggcggguggagccuccauugcgcucgauacaagccaaccacagacacgguuacagucuaucaucaaccaggucgacccuguagugauacuaugcuccgcguccaagagucaguuggccaagucaaucaucaccgagucugcaguagcauugacaauugaugaaaauucucuauccgaaaugaauuucgagccggacucagucgcccgucucccugacgucagucuggacaacaaucucuacguggucuuuaccuccggaaguacaggaacucccaagggcgucgucgucacacaucucaauuacuccacugccauucuccaccaacaagaagcgcauggcuucaagucuacuucaagaguguaugacuuugcuucguaugcuuuugaugugaguuggucaaaucucauccacacccucaccaucggcgccugucuguguauuccaucagagcaggaccguaaggacaaucucaucgaguccauacgcucacugugugcuacacauaucgaugugaccccgucuguugcucgccuuaucccugauuccuugcucugcaagauugaaacacuuguuuuagguggcgaaaagcugccugcagagcuugccagacauuugucaucgcugguaacauugaaaaauccguauggaccgagugaauguacgccuacaucaacuaucgcuacaauucgaccggaugaugaugauucaaaaauuagcagcauuggccgaggcuugggugucaacaccuggguuguagacagugagaaugaagaaauuuuggugccuauuggacagguuggagagcuauuacuugaagggcaucugcuuggcaauggcuacuugaacgaccagacgaagaccacugcggccuuugucaacaauccgcuuuuucugcucaauggcggcgauggaccugggcagccugggaggcgcgggcgucucuacaagaccggcgaccugguccguuacgagaaagacgguagcuugacauuuauuggccguaaggacacgcaagucaagauuaacggccaacgaguugagcugggugauauugagcaucauauuuaccgccacaucccacauggcaccgugucugugcgacaaauugcagcagaaauuauuucaccaaagacugguuccaaugcuguccuggcagcauuucucgaggucgaccuugguguagaggauacgggaauagcggaacaguuguuuucaaaaaccgagaagaugaugucuaacuugagaagcaaucuugcucgagaugucccuucauauaugguuccugcuguauucauuccguugaggaacuucccauugucuccgacaggcaagacagaccgacgccaacugcgggccauuggugaaucaauggacuugacugucuuggcaggcuuuggcgcagcaccuaaugaggcucggaucccucucacucugcgagagaaacaguugagaagacucuggggcucuauccucaggauugacgaaaaccuuauugcucucgacgauaacuuuuugcaaagagccggcaacccaaaugcagccaugaaacucgucacugcagcucgaagagaaggcuucucccugagcguggccaacgugcugaaguauccgcgacuucaggacauggcacaggugguuggaacaguggagcaagagcaggcacaugaaauuaugccauuugagcuucugagcgaugauauuaaucuugaucuagcccucagagaggcugcagcaucgugcaacguacaagggaaucaaauucaagacauuuaucccugcacaccgcuacaggaaggcaugaugucccuauccgcaaaacgcgagggugauuacaucaugcaguauacgcuggagcuacaccaucgaugcgacauagagcgccuagguaaagccugggcgacaguaguugcuacgacgcccauuuugagaacacgaauugucgacaucacuagccagggguugguacaggcuguucuagacgagcaguggucaaguucgucgauccaaaggaggaccuugagccaggcgagagaccacaagcaucaauucgggcuaggcaugccauuaggcagauuugaaauugucaccggcgacucgucugauuuuaagcacuacuucgucuggacacugcaccaugcccuguaugacggguggucacuucagcuuuuacucgaaaagcucgagaacgaguacgccggaaaggcagacgcgcagucaaacucacccgauuuuaaacguuuuaucaaguauauuucaacgagggauggcgagaagacucauucguucuggaccgaacaguuccaagacgucgaagcccagaucuuuccgaguuugccaucugucgacuaccagccuagaucggacaaacuguacacucauucugugggaggaauacaauggccaaaaaauggaaucaccccaucgacgacaauucgugcggcuuacucuaucuugauauccagucugaccaacagcccagauguugucuucggcagcauaacgacgggcagacaagccgccguggaugagguugaagagcuuauugcaccaacuauagccacuguaccugugcgcguuucgaucgacagcaaagacgaguugggacaguucuuacagcgaauucaaucucaggccgcagauaugauugaguuugagcagacugggcugcaucagauucgacauaucaaugcagaugcggagcgagcaugccaguuucagacacugcuuguuguucagcccgcggagggcucgggcacagcaccgagcgacauuuuuaccaacauucccgacgacauaaggaaaggagauggaaacagcgccgcagagcuggggacuuaugccuugacuauggagugucugcucaagaaagauggccuugaccuccauaugaacuauuguuccgcagucauaucggagcaucaagugcgccguuugucacagcaguuugagcauguccuuggucaaauaugucaucugacgaugauaauucacagacagagaacaacacuugaaucgcugcggcagccaacaacggaaacugagcggcagaugcagcgaaucugggcacagguacucaaccuuaaucaagcaucaauugggcuagauuacagcuuuuuccaacucggcggcgacucuauugcugccauggaaguugugacagaagcucguaagcuuggcuugaaacuggcugugucagacauauuccgucgcccgaaauugcaagacguugcaaagaaggcuugugacaguggccugcagcuuuauggagaagagcagcucaugaacgacucagaaguccaaguuaaaggagguaccgagcacacuaagcuacccaaugaugacaaggcaguugcuggccaugaaacgcagcaagucaugguaugggagggaauguucgauaaggaggucuauggaacuauuaaugauguccaauuggagaagauugggcgcgacuucaucggauggacguccauguacaauggcaaccaaauagacaaugucgaauugaacgaguggcuagacgauacuauugccacaauacgcagcagcggaucgacagccaacauacucgagcugggguccggcaguggaaugaucuuguucaaucuugucaacggccugcacaguuauguuggacuugacccgucagaaaaggccguggacuucguuuguuccacaguuaaauccauuccccaguuggccgaccgugucuauaauauaaagggaacagcagacaacaucaacagccuaggcguacccaucucugcuaacauggucaucgugaacucugucguccaguacuuucccagucaagacuaucugcucaaaguaauugaggaccuaguucagcuggaaacaguccgcacgaucuuuuucggcgacauucgcuccuacgcgcuguuucgagaguuccagguuaccagggcgcugcauauugcaggagauacugcaaccgaggacgagauccgacagaugauggccaacauggagcaagucgagcuggaguugcugguagaucccgcuuuuuucacauccuuagucgaccgguucccuggacucgucgaacauguggagauucuuccaaaaagauugaagucgacgaaugagcugagugccuaucgauacgcugccgucgugcaucucaaagacucaaaccaacuagcucagccauuacaaguccacgauauccagaaagagagcuggauuaacuauuccgggcgucaacucaaucgucagucgcuguuacaacuuguacaggauucuuucuuacgagacccgucccccucaucaguuguggccguaugcaauauaccuuauagcaugacagucuacgagaggcacgugauugaauggcuugauaguggccucacugccggucccgaugcugaggacuggcucucuucuauccgccaaacaucacaagaaugcucaucacucucggcucucgaucugcaacaaauagcucaccagacaggauggcaaguggagauuagcuggagucggcaauuuucucagcgcgguggcuuggaugccauauuccaccgacaccauucacgaggagaccgaaccagcagggcuuuguucaacuuccccacagauuaucaaggacggccaucucaaucguugagcaauuggccuuugcagcgcaagcgacagggagaggaaaagcaaauaacuuugggagauguuucuaccgucugcaaagaggacuugcaugacaucuggacuuggaaugaaguugucccagacgcccucgaggccuguguccacgaucucaucucggacacaguaagagcucagccucaauccccugcuauuugugcuugggauggugaguggaguuacaucgagcuugaugauuugucuagccgucuugcacacgcgcuugcuccguuuggcguugccaacacaguuguaccuauaugcuuugaaaagucaaaauggacaccaguggcaacgcuggcugugaugaaggccggggcagcgucagucacccucgaugccucucagccucuggagagauuacggucgauuaucucccagacugacccucgagugaucuugucaucggcgucuaagcagggcuugggugcccaacucacuaaagcuccaaaccuuguuguugaccaacauuccauuucuacuaugcacaucaccgccgagccucuucccaccguugaccccuccagcaagcuauauauuguuuucacaucuggcaccacggguguuccuaagggcguuauuaucacacacucuaacuuuagcagugccauccgacaccaacaaaaagcucaugguuucaaaucgacaucucggauuuaugacuuugccucauacgcguuugacguuagcuggucuaacuucauacaugcacuuacuguuggugccugcuuguguauuccgucagaugaggaccgccgugaugacuuggccgggucguuggagagguucggcgcuacccauguugacaugacgccuuccgcagcaagcuugcucccagagaagucauucaaaaggcuugagacgguuguacucggaggcgagaagcuuucugucgagagcgcacagcgcuggagcucacuagucagccucaagaacccauacggucccagugaaugcacgcccacggcuaccauugcgacgguaacacccaccgaugaguacaaauccaguauuggaagaggacuaggucugaauacauggauuguaaauacuguuacagacucuuuaguuccagucggcggggucggagagcuccugcucgaggggccucucguuggcgcaggguaccucggcgaugacacgaagacggccgcuuccuuuguggaagauccucaguuccuauugcaaauaugcccucaaggucaagcaagacauaccagaauguauaagacuggcgaucugguucauuacaacccggacggaagucuuaguuucguugggcgcaaggacgcucaggucaagauucauggucagcgugucgaguugaccgagauugagagccauauucgucgcaccucuaagacuauccagguggcuguuuuguuuaccaagucagggcugugugcaaauaggguaguugcauuugucugcauccagggaacuggccaaacucagacagccgccgaucaaauucgacucaucgaucccaaguauucgacccuuguuacggcuuacaccgaguccgcaaagucuagucucagcgacacucuuccugcuuauaugauccccucaauuuggauuccacuccagcauguuccguugucaacguccggaaagcucgauuacaaagcuuugaaaucauggcuugauagcauggaugccaagacguuugccaauauuuuauaugcgucugauggcgacgugaagcuucgcaaggcugagacagaauuggaacaggucauaguagaggcuugcgcuaaaauucucaacauuacagcaucgaaggugaaccuggaucggucguucauugcgaaugguggugauuccaucuccgccaugaggcucguugcucauugucgcgcggacaacgucguauuuucgguggcuaaauugcuaaagagcaaaacuuuggccgcuuuggccucaucuucaaaaaucaagucagcuuccaacguguugggcuucuaugaggaaaaaagugacucuuuugcguugucgccgauccaacagugguucuuugaacaaggucucuacaagagauccaaugacaacuucgacaaucaaggauuuuaucucaagguuaagcgcccauuauugacaaaggauauugacucggcgauuuccaaaguuguucagcaucacucuauguugagagcucgcuuucaucggaacggcgacgaguggacccaaaaaacgcuuaagccugacaccaaugguuuauaucacuuugguguccaccacacgugccuuccagcugauauagagcgacuagcucuaucacgccaccagaugaucgacaucgaaaaggggccaguauucucugcugacauuugccauaaugcguuuggagaacaguaccugauccugauugcucaccaucuuguuguugauuuagucucguggcgugucauccuggaggacauagaaucucuacucggugguaguaauuugcaaccaagucuuccauuucaagucuggaaugauaugcaaauugagcgggcgaaggaaucgagccuacuugauccugaaaauguucuaucaaccacuggaauuaauaacaaccucgauuucuggcaagccacagcagaaaccaagaacaccgucgaagaucaccuaaauuucuguaccaagaucgacagcagcauuacagagcucauccucaaagacgcaaauuacccguucaacacugaaccuguggaccuccuucuugcggcuguuuggcaugcauucuucaagacguucccccaaagagacggucucacuauuuuuauugaaggacauggucgcgagccgugguccucggauauugaucuuucccgcacugucgguugguuuacuaccaucagccccauucaugugucaaagagcgacguacacaagucugucgcaagucuaguacgcguugucaaagaugcucggcggcuccugccugcaaauggcugggcuuacuuugcuucucgauauuucaaugaaucgggaaaaucagcguucaaaucgcacgacucuauuauggaaauaaccuuuaacuaucacggccaauuucaacagcuggagaacgagaaggcgauguuugaaaauguuacgcucaguggagucugcgagcaaggaccagcucuucccgccucuuccuugauugcugucgaagucucgauagaucgagggcaggucaccuucgacguuucugccaaccgcuacauuaaucaccaggauuguauuucaaauuggaucaaagcaauuucacagucauuggagaccauuuccaaugagcuugugucuacagaaaucucacaucgcacgcuuugcgacuacgaauuucugagccucggguauacggagcuggaucgauuacaggaaagugucaucccagaaauugagaagcuaaauaauuccacaguagaaugcauuuaccgcugucuucccacaguugaugguauucugaucagccaguucaaagacccagaaucguauaaaacagugcaacauuucgagauuacuucccacaucgacgaccaaaucgaccuagagcaucuuucucuagcauggcaaaaagugguugccaaucaaccugcucuacgaaccgucuuuaucccuggcauggacaaagccgcugcauucaaucaaguugugcugucucaguaccacgccgagcucaucauccugcauacugccagcgacgaguacaccgaagccuuggagauguucaagaauuuaaucccaaucaauuaucagagcuucaagccaccucauagagccgcgaucugucgaaucucaccuaguagaguacucugccagguugagaugagucaugccaucacagacggugcaucgacaucuauuuuggccaaugaucuucuccaggcauacaacggcaacucgaugccaauaaaucucauggacacagcaugugaguuugcucgggcccaacucacuuccucuuuuggggaaaaacugucauacuggaagaaaaagcuuucgggaauggaucccugccacuuccccaaaaucucgggugcuucaacacaaggcaccgguacauccgucugcaaaauucguggcgcucuguuuagcaaaauccaggauuauugcaauucaguagaagucacgacggccaguuuauuucagaccauaugggcacuuacucuggccgccuauaccggcaacgacucgacaugcuuuggguaucuagcaucuggccgcgacuugccuauugcuggcaucgauaaaucuaucggugcauucacaaacauguugacuguucaugaucaaguuaugcaagaucuggagcaccagcacugcucacuagcaagcauccagcaugaacuaggcauaaauuccgauaacccucuuuucaacuccauccuaucauaucagaagcaggacgaugagccggcagagacgagguacgacauuguguugaauauugggcacgcuaccgaccacaucgaaauuguuuuugacuauaaacacgccugccuuucaagcauccaggcagagagcguacuuucacucaugcaaucuacagcugccgcucuaguucagcaugcuucgggagaucaucagacuuuaagaagcgucaacaugguuagcacugaagauauaucugacauauggcaauggaacucagacguuccagucacugucgacgauugugugcaucauaucauuacgcgaacuugucauaaacgcccccaagcuccggcaaucugugcaugggauggcgauuggaccuaugcugaagucaauaagcugucagauaaacuugcccaccuucuagucuccuaugguguuggcccuggagugguugucccgcuuugcuucgaaaagucaaaguggacacccauagcaaugauggcugucaugaaggcaggaggcgcaucuguugccauggacucaacccaaccagaggaacgccuacgagcaaucguaaaccaagugaagucaccuauuaucuugucaucauuugccaacgaacagcuugcaagccgacuaaucagcgagcuucccagccccaccaagguccucacaauaagcgacaaagaaguggaaaauuugaauguuccgaguggaagccaacuuccucaugucaaccccagugauacucucuaugugguauucacauccgguaguacaggggugccaaagggaguggcaguuacucacuccaacauugccagugcgaucaaacaccagcgacacuugcuuggauucacuucugaaucuaggguauucgacuuuucuuccuauauguuugauguugucuggugcaacuuacuacagggucuuucugcuggaagcugcguuugcaucccgagcgacaaugaaaggaagacugacuuuauggccgcuauuguuaagaugagggcaaaccuugucauauugacaccuucugcuauccgcggccugaagcuugacgcucugaacagccuaugcaacguccacuucaucggcgaaccuuuacauguugacacuuuuagaucaguugacgaaagugucacgauauccaaccuauauggccccacugaauguacaacauucagcacaguacaaaccaucugcggcagacagcaucagucaaucacaauuggcaagggagcgggucugaauaccugggucgcggacauagccacugguacggcucuuguaccaauuggcagugcgggagagcuucuacuugaaggcccauuagucgccgccggcuaccggggugaugcugucaaaaccgcugccgcauucguauaugacccgccauuucuucugcguggaucggugggccacccugguagacguggccgccuauacaaaaccggagauauuguucgguauaacuccaacgguacuuugacuuuccuuggccgaaaggauucgcaagucaagaucaacggacagcgaguugaguucggugauauugagucucacauaaacggggcgcugcuaccggacuucagugaaggucaagcuuuagucgacuuuguaacaccucaaggaagcucacguccaaugcuuguagcuuuuguuuacuucggaccuacugucacugagggcauggaugaggccgaucugcuaagccuagccaagcgcacagccauaucgcuggaugagagucuugcugcucgaaucccugcauucaugauaccaucugcuuauauuccauugcagaaaauuccugucacagcgacaggcaagacagaccgccgucguuuacgcgagauggccaaagauguuaccugggaccagcucauuaaagcugacucccacgguccugaucguugucaaccuggcacagagauggagauacagcugcagauccuaugggggacugugcuaggaguugaaaguaguuugaucggugcacaugacaacuucaugcgcgucgguggugauuccgugggcgcaauacgcuuagcgaguucugcccgggaacuugguuucacgcugaacguggcugauauucucaagaacccgaaacuaagugauauggcaaaacuuaugauacgaacagagccgucgcaggauauuucaaucaaggaauucucucuccucaaaccuggcucugaugucaacugggcuguugcagagacauccgcuuuauguggcguggacgguaaccaaguugaagauuuauauccuugcacaccccugcaagagggcuugcuggcgcugacaacaaagcgccccggcgacuauaucauccggugcauuuuggaacugaagagaucaacagacgucaaaaaguucugcgccucuugggaggcgguguuggagagcaccccaauacuacgaacucggaucguagacaucgcggaacaagguuuggugcaagcugucaucaagcaaccagcacaguggacaucggcagaagccuccaguuuggucgacuucguggcugcugauaaugagaagacaacuggucuggguaugcccuuggugcgauucggacuaguacaagagacgaacaaacacuuuuuuguuuugacucugcaucaugcaguauaugauggcugggcgcugaaucuggucuucgaaaagcucgaaaauuuuuaugcugggucuuccaggcaugaaagcccggauuucagacacuucgucaagcacauuucaagucucgacaacgacgcggcugccaaguuuuggaaagaccaacuccaaggcucagaggcacccacuuuucccuccuuaccaacugccacguucgugcccaagucugaaaagaccauuuugcacacaguugaagaguugcaguggcccaagacuaaugucacugcuuuuacguuggugcgugcggcacugucacuuuuaacggcggccuacaccaauucagaagacguuugcuuuggcgugacuuccaacggucggcagguugggcucccuggaguagaaagaaugauaggcccgacuauugcgacagugccaguucguguucgcauugaccgcgagcagcgucuccaagccuuccucacacagaugcagcaucaguccauugacaugauagcguuugaacaauuuggucugcagcaaauacggaagucaaguccugacgccgaacgggccuguaacuuccagucacuucucauuguccagccggcagaagagacagcccaguggcagagcgauauaauugcccgugauaucggagaaggagcugaugauccuaugggcauucaagaaauuggaacauaugcccuuacucucgaaugccaucucggacccgacaguuugcucauaaaggccaacuuugauuccaauguaaucgaugaacuacaggucaagcgauuuacaaagcaguuugagcacgugcuucgucaaauaugcugcucugguaguggccuugucguuucugauauugauaccaccagcagacaagacauggaagauauuuggaaguggaaugccguagucccccagucagucaacacgccuguucaugagcucaucuccucuguggcacgcagacugccgcauguccaagcuguaugcgcaugggacggcaacuggacuuaccgucaacuggaugaccugucaaauuauguugcgcaccaccucgucgaccuugguguuggcucucaggacaucguaccgcuguuguucgagaaguccaaguggaugccgaucgcgaugcuuggugucaugaaagcaggggcugcgucgguggcugucgauaccagucagcccaaagaccgacuucgcaugauuaucgaccaggcaaaucccacggucgcgcuaagcucagcugauaaguugccucuuguccggagucugacaaaggcgcaaagcuucguugucaguggccaagguauugaccgcuuauuaaaaccuagccuuaaugcuacacuuccaguugucgauccguccagcagacuguauuuggucuucaccucugguaguacgggugucccgaaggguguuauaauucgacauugcaauuuugccagugcaauuaaacaccagaaagaaguucaaggcauccuuccaaccucgcgugucuaugauuuugcuucauaugcauuugacgucgcaugggccaaugcgcuacugaccuuugagagcggcgcuugucucuguaucccauccgaugcugacagaaagaaugaucuaaacgguucgauugcgcgacugaagccaacucacgcugaucuuacgccuucggcagcacugguccuguccaaagagucacuucagcagcuugauacccucacuuuagguggcgaacgucuccuagcggaguacgcaacaaaguggucccaguuugugacaguuaaaaacucauacggaccaagcgagugcacuccaacugccacauuuaccgaggcaauugggcguggauacgaucuuggugcuagcauugguaagccugcuggucucaacacuugggugguugauccugugacggggcagucgcucguucccauuggaggcgucggcgagcuguucuuggaggggccgcuugucggugcuggcuaucuugaugaugcagagaaaacgaaugcugcuuuuauccaugauccaccauuuuugcuccgcggcaacguugucgcgcaaccuggacgacgcggcacgcuguacaagacgggugacauugugcgauacaacucagauggcagucucacuuuuguuugucggaaagauacacaagucaagaucaauggccagagaguagagcuugcugagauugagagucauauagcucuauacacagcgacccgacaaguggcgacccuauugccuagcacuggccucugugcaaacaagcugguagcuaugaucagccucacagaugugaacuaugauguuagcgaggaccucgccgaaaacaagauugagcuggcaucuucggaacaugaccaacucaucaaugagcacaucgaggcccuucaaucguuauugcgcgagucuuugccgcaguacaugauuccaucucuguggguggucuuguacaaccucccuaugacagcaucgggaaagcaagacaauaaggcacucaaauccuggcuggaaaauauggaugaaacgcucuuuucuaaaaucaacaaugcgaacgguagcgacauuauccgaaaaccagacacagaagacgaaagaguccucagccagaaaugcaguauuguccuuaauaugcccgucgacaagaucaaucucgacaaaucuuuuauugcgaaugguggagauuccauuuccgccaugaggcuugcaucccacuacagaacugugggaauuuccaucucagucucaacacuccuucaaaguaaaacccucgcggauuucgcagcauuuucgggcgcaacagccauuagcggagucagucaggaagagcauacugacguuccuuucgaacuaucacccauccagcagugguucuuugaccaaucgccauuuaugagccagcagaagcaugacagauucuacaaccaaggauucuaugugagacucaggcgcacagugagaaucaaugaucuagaaucagccuuucuuucucuggucaaucgccacgcgauguuacgcucgcgauuucagcaucaugggggcaaauggaagcaaauaauccucagucacagcaaacgagcucuucauuugaacguaucgcagcaccuguccaugagcgagauugcaucguuagcucaagagcggcaccgacagauugacauagagaaagguccugucuucucgguugauauuugcuuacuaggccagcagcagcaucuggucaugauagcccaucauuugguuaccgacuuggucuccuggcggauuaucuuagaugaucuggagacuauucucaacggccauucccuaacggccgcucuacccuuccaaguguggagcaggcugcaagcugagcgggcuguaucuuccacuuugaagccucacaacuugcugucgacugacggcguccauaacaaucucaaguuuuggaaguauacgcacgacacgcccaacugcuuggcagaccacaggcuccgaucggucacuauugaucgagaaacuacggcuguacuacugggcgaggcaaacaaugccaugaauacagagccaguagagauccuuuuaucagcuguuugggaugcauucuuucggacguuuucccagcgcaacagccugaccauauucaacgaaggucauggucgcgaagcuugguccgaugaaauugacuugucgagcacuguuggaugguuuaccacacucagucccaucaacaucuauagaaauaaugccaccagcgagaccgacauggugcggcucgucaaggaugcccgccgcagccuucccgcgaacggcuggucuuacuuuaccucccgauaucugaaccccgacgggcaaagagcuuuugaaagccauaacacggugucugaaguuguuuucaauuaucauggccaauuccaacaacuagaaagucaucaagcccuuuuugaagacauugaucuugucgguguacgugugcaaggucgcucaauaucugcagggucuuuguuuaacaucgagguugccauugaagcaaugcaagcgcacuuugaauucuccguuaaucaaaauaucgcucaucagagcuugauuaaccaguggauugaccaaauucaacccucuuuggaaaggauuugccucguccuucucgaggccaacccaacgcauacgcugugugacuucaaguucaucagucucgacuaccagcgccuugacgaucuuaccagucgacuacuuccggagaucgagucaaucaaccaaucaacuguugaggagauuuucucgugcucuccgauugucgauggaaugcuccucagucagauaaagcagccagaaucauacaagacacuucagcgauacgagguguugucaucucaugaccauccuaucugucucgacacccucaaaauugcuuggcaaagggugauuucucgccagccugccuugaggacaguuuucaucgcuggccuugacggaucuaccgccuuuuaccaggcccuucucaaacagugcuccggggauguuaucguuguugaggcuaaaacugaagaggaagcccugaaagccuuuuccucgcuuccgaaagucgauuaccaacaggccaaaccuccucaucgccucacucuuugucaaacgccggaugacaaagucuuuugucagauugaaaugagccaugcuauuacugauggugccucuuccaacauuuugauuaaggaucugauugacgcuuauggugauaggcugucgucaacagaccuugucaaaacaacacgcgaauuugcuagccacuugcuggcuaagccacagucccaaaagauuucguauuggaacacaaaacucaagggccuugaaccuugccgcuuuccaucccuaucgagcaugucucgggagaagcacgaguguagcucggagauuggaguuuuugucgaagacaagauguuugcgcagauucaagacuucuguagcauaaaccaggucacgccagcaagucuccucaaaagcgccugggcuuugacacucucgaccuacguacaaaaucaaucugucugcuuuggcuaucuggcaucuggucgagaccucccaaucgccgggauggacgaaucugucggcgcuuacacuaacaucauggucugccgugccgauuuggaugggcaacagccugguguggcacucgugcgacaacuucagaaucaauuaaugcaggacuugagcuuccaacauauaucgcuugcuagcauucaacaugagcuuggacuggcguccgaucagcagcuuuucaacucuauugucucuuuucagaggucaggagacgauaaugaacaaucagcagaggaggguaaacuucgauucaagaauauugaugguuuggacccaacagaauacgacaucguauuggguaucaaccaaggaaccagguccaucgaaauugaccuugaauucucacacagcugucucacuaguaaucaggcaaaacgcauucucgagcaucugcagucaaacauugccgcuauucuucacaaugagccaccugcucugaucagcccccaagaugagcaagauauuuggagcuggaacuccacuguuccugacauggucaacaucugcguucacgaucugaucuccaagauaguauuccgccagccugaugcaccagcuguuugcucaugggacggcgauuucaccuaugcggagcuggauaaucuugcaacacgccuugccaauagccucagcaagaugggcaucggaagaggcagcaucgucccgcuauguuuugaaaaauccaaauggacaccaguugccaugcuagcaguuaugaaaacaggugcagccucuguuacgauggauacuagccagccugaagaacggcuccagucuauuguugcacagguggaugcuaagcuugugauuucuucgacauugaagguugagcuagcagccaggcucacaacggcucccgucuuggcuauagacaaagccagcaugaaggcgauggcugacgauacgccgcuggcugcagucgaucccgcaaacaguauuuacauugucuucacaucagggagcacuggcacgccaaaaggugucauuaucacucauaccaacuacagcagcgccaucaagcaucagcagagugaacacggcuucaagccaaccucuagggucuuugacuuugccucuuaugcguucgaugucagcugguccaauuucuugcacaccuugaccauuggggccugcuuaugcauuccuucugaugaugaucguaaaaaugacccggcgggcgcaauugaccgcuuacgguguacacacguugauaugacccccucggccgcaagcgucuuaccugccaguacguuggcuaaauuggauaccauuguucugggaggcgagaagcucucgcuugaauaugcccaacgcugguccgcccugacaagcgugcguaauccguacgggccuucugaaugcacaccgacgucgacaauuacggagaucaauucugcggaaauaagcaagggcaaagugagcaucggcaaaggagugggacucaauacuuggauuguugauccugccacugcacaacauuuaaugccgauuggcaucccuggggaguuauuacucgaagguccgcuuguuggugcuggcuaucuuggagacccugucaaaaccgcuucagcauuuauugaagacccagaauuccuagucaaaggcgcuaguccaggaauuccaggccgccguggucgucuguacaggacgggcgaucuagucaccuauaauaccgaugguagcuugucauuugugggccgaagggacucucaaaucaaaauaaacgggcaacgcgucgaauuaggcgacaucgagucgcacguuucugcaaaccuggugagucauggcagugcucagguugcggucgagguugugucaccccaagcuagcuccaacaacauacuugucgccuucgugagcuuugacgaccugaauucuaucaaccugaaugaugaaaagcuucuugcccgcacgaaagcggcgaccgagggaauuagggagaaacucgcgacacaaaucccaucuuauaugauuccuucggucuacaucccuguuacuguuuuucccacaacagcuacugggaagacugaucggcgccgauuacgugaaauggccucaagccucacccuggagcagcuuaccucaaucaaccaagcucaacagcaauaucaaccccccacuacucccuuggaaguggcacuucgggagcucuggaucucaguccucaaauuaggaucgcgaaaaauuagcacuacaaacaacuucuucgaacuugguggagauuccaucggugcuaugaggcugguaggcgcggcccgugaccacggacuaucgcuuuccguuguagauauuuucaagcauccuaaguucagcgaaauggcugcuuugcuucguucuguggauaagccgcaguuggaagagccacggguauuucaacccacuucgcuucuguccaaagaucacaacaaagaccagauacucucucgacucuuugacuuugguauugacuuggaaaauguugaagacauccucccugucacggaucaucaagcucguuccaucgcgaugacucacucugcgucccgcgacuugcuacucuaucacacuuuagauagcaagggcgugccaaauaugcgcaagaugcgagcagugugcaaugagcucgucaauagauaugaucucaugcgaacccuuuucaucgcacauaaagacagcuucuugcaggucgugcugaaggccuuuccuguggauauaaccgucuugagaauugagaaugccagccuagaggaaugcacagaagagcuacgauuacgcgacagggacgaugagcuccguuauggcucgcuccuaacaaagauugcuauuuugcaucaaauccgcgacaacgaauaccgucuugugguccgcauuucccaugcucaacaugacggaaugagcuugaugaaaauguggaacgcauuugaagaaauguacggugacgggagugacgacucauuccacauuccuucggacacuagcuuccaagaaaagucuaaggcuaguuucuccaacuacaugcaugccguggcugguacaaaccgggagcaagcuaagucucacuggcgcagacuccucaagggcucuagcaugacgaaccucaagccccaugcuucauaugcccugaccuuuggcgaaggaccaugugucgccagacauguuccuaagagcauugcucaagguacuggauuuacauuucauacuguacugaaggcugcuugggcguacguucuggcaaaacaccuugccaacgacgacgugguuuucuguagccucacucacggucggggcuugcccgggacacaagaugucuuuggagacugcgugaacaucauuccuacucgaguaucuuuuaccgacggauggacuguucgcgaccuucucagugcauugaacacccaacagauugcgagcauggagcaugagaauauaggcacacgcgaaauuguccgugacuguacuacauggccgaaguggacauaugcaggauccaucguuuaucaccaugacuuugacgauggagaacauauugcucauaaccgcaguaugcacguugagcaggagcuaaaucugucucacggcaaaguggacaugaccgacguucauaucacuucuaagccugauaacaacauguuccgaauugagcuggacuucgcacauggcguggugucugagcgugacgcugaacugcuagcugcgaaacugacggagucuaucaucguuuucugcaaugucauggaccagccuuuguuaucucccgacgagaucagauaucugcggacaaccacauugcugcccucagaggagccucucagugcaaccccaacaaaugaacaguuaaugguugcuagcauuagcccgacugaaaugcaaugggcgcuugagagugcguggaaggacacuuucaauugcccccuuaguccugaggugaaagcgggcaagacaauuuuugaucuugguggugacuugauaagcgcuagucugauaucagcucacauggagaggcaaggauauguccuuaguguugaggaugucuuggggaauccgacgugguucucgcaacugacgcuguugacgaagcgcacucuucgggauguugaugucuga

SEQ ID NO: 14 - protein, 7035 aa, Aspergillus niger
MRSPNDLTTSATMEDIHQIWSWNANVPEAGETCVHTLITDKALQQPDALAVDAWDGRWTYGELETTSTKLALRLLDLGVGPGTNVVICFEKSKYTPLAMLAVMKAGGASIALDTSQPQTRLQSIINQVDPVVILCSASKSQLAKSIITESAVALTIDENSLSEMNFEPDSVARLPDVSLDNNLYVVFTSGSTGTPKGVVVTHLNYSTAILHQQEAHGFKSTSRVYDFASYAFDVSWSNLIHTLTIGACLCIPSEQDRKDNLIESIRSLCATHIDVTPSVARLIPDSLLCKIETLVLGGEKLPAELARHLSSLVTLKNPYGPSECTPTSTIATIRPDDDDSKISSIGRGLGVNTWVVDSENEEILVPIGQVGELLLEGHLLGNGYLNDQTKTTAAFVNNPLFLLNGGDGPGQPGRRGRLYKTGDLVRYEKDGSLTFIGRKDTQVKINGQRVELGDIEHHIYRHIPHGTVSVRQIAAEIISPKTGSNAVLAAFLEVDLGVEDTGIAEQLFSKTEKMMSNLRSNLARDVPSYMVPAVFIPLRNFPLSPTGKTDRRQLRAIGESMDLTVLAGFGAAPNEARIPLTLREKQLRRLWGSILRIDENLIALDDNFLQRAGNPNAAMKLVTAARREGFSLSVANVLKYPRLQDMAQVVGTVEQEQAHEIMPFELLSDDINLDLALREAAASCNVQGNQIQDIYPCTPLQEGMMSLSAKREGDYIMQYTLELHHRCDIERLGKAWATVVATTPILRTRIVDITSQGLVQAVLDEQWSSSSIQRRTLSQARDHKHQFGLGMPLGRFEIVTGDSSDFKHYFVWTLHHALYDGWSLQLLLEKLENEYAGKADAQSNSPDFKRFIKYISTRDGEKTHSFWTEQFQDVEAQIFPSLPSVDYQPRSDKLYTHSVGGIQWPKNGITPSTTIRAAYSILISSLTNSPDVVFGSITTGRQAAVDEVEELIAPTIATVPVRVSIDSKDELGQFLQRIQSQAADMIEFEQTGLHQIRHINADAERACQFQTLLVVQPAEGSGTAPSDIFTNIPDDIRKGDGNSAAELGTYALTMECLLKKDGLDLHMNYCSAVISEHQVRRLSQQFEHVLGQICHLTMIIHRQRTTLESLRQPTTETERQMQRIWAQVLNLNQASIGLDYSFFQLGGDSIAAMEVVTEARKLGLKLAVSDIFRRPKLQDVAKKACDSGLQLYGEEQLMNDSEVQVKGGTEHTKLPNDDKAVAGHETQQVMVWEGMFDKEVYGTINDVQLEKIGRDFIGWTSMYNGNQIDNVELNEWLDDTIATIRSSGSTANILELGSGSGMILFNLVNGLHSYVGLDPSEKAVDFVCSTVKSIPQLADRVYNIKGTADNINSLGVPISANMVIVNSVVQYFPSQDYLLKVIEDLVQLETVRTIFFGDIRSYALFREFQVTRALHIAGDTATEDEIRQMMANMEQVELELLVDPAFFTSLVDRFPGLVEHVEILPKRLKSTNELSAYRYAAVVHLKDSNQLAQPLQVHDIQKESWINYSGRQLNRQSLLQLVQDSFLRDPSPSSVVAVCNIPYSMTVYERHVIEWLDSGLTAGPDAEDWLSSIRQTSQECSSLSALDLQQIAHQTGWQVEISWSRQFSQRGGLDAIFHRHHSRGDRTSRALFNFPTDYQGRPSQSLSNWPLQRKRQGEEKQITLGDVSTVCKEDLHDIWTWNEVVPDALEACVHDLISDTVRAQPQSPAICAWDGEWSYIELDDLSSRLAHALAPFGVANTVVPICFEKSKWTPVATLAVMKAGAASVTLDASQPLERLRSIISQTDPRVILSSASKQGLGAQLTKAPNLVVDQHSISTMHITAEPLPTVDPSSKLYIVFTSGTTGVPKGVIITHSNFSSAIRHQQKAHGFKSTSRIYDFASYAFDVSWSNFIHALTVGACLCIPSDEDRRDDLAGSLERFGATHVDMTPSAASLLPEKSFKRLETVVLGGEKLSVESAQRWSSLVSLKNPYGPSECTPTATIATVTPTDEYKSSIGRGLGLNTWIVNTVTDSLVPVGGVGELLLEGPLVGAGYLGDDTKTAASFVEDPQFLLQICPQGQARHTRMYKTGDLVHYNPDGSLSFVGRKDAQVKIHGQRVELTEIESHIRRTSKTIQVAVLFTKSGLCANRVVAFVCIQGTGQTQTAADQIRLIDPKYSTLVTAYTESAKSSLSDTLPAYMIPSIWIPLQHVPLSTSGKLDYKALKSWLDSMDAKTFANILYASDGDVKLRKAETELEQVIVEACAKILNITASKVNLDRSFIANGGDSISAMRLVAHCRADNVVFSVAKLLKSKTLAALASSSKIKSASNVLGFYEEKSDSFALSPIQQWFFEQGLYKRSNDNFDNQGFYLKVKRPLLTKDIDSAISKVVQHHSMLRARFHRNGDEWTQKTLKPDTNGLYHFGVHHTCLPADIERLALSRHQMIDIEKGPVFSADICHNAFGEQYLILIAHHLVVDLVSWRVILEDIESLLGGSNLQPSLPFQVWNDMQIERAKESSLLDPENVLSTTGINNNLDFWQATAETKNTVEDHLNFCTKIDSSITELILKDANYPFNTEPVDLLLAAVWHAFFKTFPQRDGLTIFIEGHGREPWSSDIDLSRTVGWFTTISPIHVSKSDVHKSVASLVRVVKDARRLLPANGWAYFASRYFNESGKSAFKSHDSIMEITFNYHGQFQQLENEKAMFENVTLSGVCEQGPALPASSLIAVEVSIDRGQVTFDVSANRYINHQDCISNWIKAISQSLETISNELVSTEISHRTLCDYEFLSLGYTELDRLQESVIPEIEKLNNSTVECIYRCLPTVDGILISQFKDPESYKTVQHFEITSHIDDQIDLEHLSLAWQKVVANQPALRTVFIPGMDKAAAFNQVVLSQYHAELIILHTASDEYTEALEMFKNLIPINYQSFKPPHRAAICRISPSRVLCQVEMSHAITDGASTSILANDLLQAYNGNSMPINLMDTACEFARAQLTSSFGEKLSYWKKKLSGMDPCHFPKISGASTQGTGTSVCKIRGALFSKIQDYCNSVEVTTASLFQTIWALTLAAYTGNDSTCFGYLASGRDLPIAGIDKSIGAFTNMLTVHDQVMQDLEHQHCSLASIQHELGINSDNPLFNSILSYQKQDDEPAETRYDIVLNIGHATDHIEIVFDYKHACLSSIQAESVLSLMQSTAAALVQHASGDHQTLRSVNMVSTEDISDIWQWNSDVPVTVDDCVHHIITRTCHKRPQAPAICAWDGDWTYAEVNKLSDKLAHLLVSYGVGPGVVVPLCFEKSKWTPIAMMAVMKAGGASVAMDSTQPEERLRAIVNQVKSPIILSSFANEQLASRLISELPSPTKVLTISDKEVENLNVPSGSQLPHVNPSDTLYVVFTSGSTGVPKGVAVTHSNIASAIKHQRHLLGFTSESRVFDFSSYMFDVVWCNLLQGLSAGSCVCIPSDNERKTDFMAAIVKMRANLVILTPSAIRGLKLDALNSLCNVHFIGEPLHVDTFRSVDESVTISNLYGPTECTTFSTVQTICGRQHQSITIGKGAGLNTWVADIATGTALVPIGSAGELLLEGPLVAAGYRGDAVKTAAAFVYDPPFLLRGSVGHPGRRGRLYKTGDIVRYNSNGTLTFLGRKDSQVKINGQRVEFGDIESHINGALLPDFSEGQALVDFVTPQGSSRPMLVAFVYFGPTVTEGMDEADLLSLAKRTAISLDESLAARIPAFMIPSAYIPLQKIPVTATGKTDRRRLREMAKDVTWDQLIKADSHGPDRCQPGTEMEIQLQILWGTVLGVESSLIGAHDNFMRVGGDSVGAIRLASSARELGFTLNVADILKNPKLSDMAKLMIRTEPSQDISIKEFSLLKPGSDVNWAVAETSALCGVDGNQVEDLYPCTPLQEGLLALTTKRPGDYIIRCILELKRSTDVKKFCASWEAVLESTPILRTRIVDIAEQGLVQAVIKQPAQWTSAEASSLVDFVAADNEKTTGLGMPLVRFGLVQETNKHFFVLTLHHAVYDGWALNLVFEKLENFYAGSSRHESPDFRHFVKHISSLDNDAAAKFWKDQLQGSEAPTFPSLPTATFVPKSEKTILHTVEELQWPKTNVTAFTLVRAALSLLTAAYTNSEDVCFGVTSNGRQVGLPGVERMIGPTIATVPVRVRIDREQRLQAFLTQMQHQSIDMIAFEQFGLQQIRKSSPDAERACNFQSLLIVQPAEETAQWQSDIIARDIGEGADDPMGIQEIGTYALTLECHLGPDSLLIKANFDSNVIDELQVKRFTKQFEHVLRQICCSGSGLVVSDIDTTSRQDMEDIWKWNAVVPQSVNTPVHELISSVARRLPHVQAVCAWDGNWTYRQLDDLSNYVAHHLVDLGVGSQDIVPLLFEKSKWMPIAMLGVMKAGAASVAVDTSQPKDRLRMIIDQANPTVALSSADKLPLVRSLTKAQSFVVSGQGIDRLLKPSLNATLPVVDPSSRLYLVFTSGSTGVPKGVIIRHCNFASAIKHQKEVQGILPTSRVYDFASYAFDVAWANALLTFESGACLCIPSDADRKNDLNGSIARLKPTHADLTPSAALVLSKESLQQLDTLTLGGERLLAEYATKWSQFVTVKNSYGPSECTPTATFTEAIGRGYDLGASIGKPAGLNTWVVDPVTGQSLVPIGGVGELFLEGPLVGAGYLDDAEKTNAAFIHDPPFLLRGNVVAQPGRRGTLYKTGDIVRYNSDGSLTFVCRKDTQVKINGQRVELAEIESHIALYTATRQVATLLPSTGLCANKLVAMISLTDVNYDVSEDLAENKIELASSEHDQLINEHIEALQSLLRESLPQYMIPSLWVVLYNLPMTASGKQDNKALKSWLENMDETLFSKINNANGSDIIRKPDTEDERVLSQKCSIVLNMPVDKINLDKSFIANGGDSISAMRLASHYRTVGISISVSTLLQSKTLADFAAFSGATAISGVSQEEHTDVPFELSPIQQWFFDQSPFMSQQKHDRFYNQGFYVRLRRTVRINDLESAFLSLVNRHAMLRSRFQHHGGKWKQIILSHSKRALHLNVSQHLSMSEIASLAQERHRQIDIEKGPVFSVDICLLGQQQHLVMIAHHLVTDLVSWRIILDDLETILNGHSLTAALPFQVWSRLQAERAVSSTLKPHNLLSTDGVHNNLKFWKYTHDTPNCLADHRLRSVTIDRETTAVLLGEANNAMNTEPVEILLSAVWDAFFRTFSQRNSLTIFNEGHGREAWSDEIDLSSTVGWFTTLSPINIYRNNATSETDMVRLVKDARRSLPANGWSYFTSRYLNPDGQRAFESHNTVSEVVFNYHGQFQQLESHQALFEDIDLVGVRVQGRSISAGSLFNIEVAIEAMQAHFEFSVNQNIAHQSLINQWIDQIQPSLERICLVLLEANPTHTLCDFKFISLDYQRLDDLTSRLLPEIESINQSTVEEIFSCSPIVDGMLLSQIKQPESYKTLQRYEVLSSHDHPICLDTLKIAWQRVISRQPALRTVFIAGLDGSTAFYQALLKQCSGDVIVVEAKTEEEALKAFSSLPKVDYQQAKPPHRLTLCQTPDDKVFCQIEMSHAITDGASSNILIKDLIDAYGDRLSSTDLVKTTREFASHLLAKPQSQKISYWNTKLKGLEPCRFPSLSSMSREKHECSSEIGVFVEDKMFAQIQDFCSINQVTPASLLKSAWALTLSTYVQNQSVCFGYLASGRDLPIAGMDESVGAYTNIMVCRADLDGQQPGVALVRQLQNQLMQDLSFQHISLASIQHELGLASDQQLFNSIVSFQRSGDDNEQSAEEGKLRFKNIDGLDPTEYDIVLGINQGTRSIEIDLEFSHSCLTSNQAKRILEHLQSNIAAILHNEPPALISPQDEQDIWSWNSTVPDMVNICVHDLISKIVFRQPDAPAVCSWDGDFTYAELDNLATRLANSLSKMGIGRGSIVPLCFEKSKWTPVAMLAVMKTGAASVTMDTSQPEERLQSIVAQVDAKLVISSTLKVELAARLTTAPVLAIDKASMKAMADDTPLAAVDPANSIYIVFTSGSTGTPKGVIITHTNYSSAIKHQQSEHGFKPTSRVFDFASYAFDVSWSNFLHTLTIGACLCIPSDDDRKNDPAGAIDRLRCTHVDMTPSAASVLPASTLAKLDTIVLGGEKLSLEYAQRWSALTSVRNPYGPSECTPTSTITEINSAEISKGKVSIGKGVGLNTWIVDPATAQHLMPIGIPGELLLEGPLVGAGYLGDPVKTASAFIEDPEFLVKGASPGIPGRRGRLYRTGDLVTYNTDGSLSFVGRRDSQIKINGQRVELGDIESHVSANLVSHGSAQVAVEVVSPQASSNNILVAFVSFDDLNSINLNDEKLLARTKAATEGIREKLATQIPSYMIPSVYIPVTVFPTTATGKTDRRRLREMASSLTLEQLTSINQAQQQYQPPTTPLEVALRELWISVLKLGSRKISTTNNFFELGGDSIGAMRLVGAARDHGLSLSVVDIFKHPKFSEMAALLRSVDKPQLEEPRVFQPTSLLSKDHNKDQILSRLFDFGIDLENVEDILPVTDHQARSIAMTHSASRDLLLYHTLDSKGVPNMRKMRAVCNELVNRYDLMRTLFIAHKDSFLQVVLKAFPVDITVLRIENASLEECTEELRLRDRDDELRYGSLLTKIAILHQIRDNEYRLVVRISHAQHDGMSLMKMWNAFEEMYGDGSDDSFHIPSDTSFQEKSKASFSNYMHAVAGTNREQAKSHWRRLLKGSSMTNLKPHASYALTFGEGPCVARHVPKSIAQGTGFTFHTVLKAAWAYVLAKHLANDDVVFCSLTHGRGLPGTQDVFGDCVNIIPTRVSFTDGWTVRDLLSALNTQQIASMEHENIGTREIVRDCTTWPKWTYAGSIVYHHDFDDGEHIAHNRSMHVEQELNLSHGKVDMTDVHITSKPDNNMFRIELDFAHGVVSERDAELLAAKLTESIIVFCNVMDQPLLSPDEIRYLRTTTLLPSEEPLSATPTNEQLMVASISPTEMQWALESAWKDTFNCPLSPEVKAGKTIFDLGGDLISASLISAHMERQGYVLSVEDVLGNPTWFSQLTLLTKRTLRDVDV

SEQ ID NO: 15 - DNA, 21488 bp, Aspergillus niger
tctcctcgggcctcgggttccccccaggttgagagggcaccctcttttgacaaagcttagctgagatcgaccattacgttgagatggcattacttcatcctccgtgaaacgtgcacctttacgctactactgtccgcgattgccggtcggagcagaaactggaccatgctgctgccttcccatccccgctattacctaacagatatccttctctatgggcaagccgggctcacctccaatgcgggggcgccatttattcatcccccggattctcctcgtgtggagatttttacgctgggagttcgtatcaccatcctctctggccttggaattctccccactgagtcgataccccatactctgacgtcggacggttgtcgcaaagggcagggatgggcaccgggctgaatactgttgggatgtatgtggagctggtgtttgccctccattacataaaagaaaatgctgtcagtctgatgcaggagctcctccttcttgctctgtggtgggaaagtgtacctccgcaacggcagatgcccggttcataccccaggtcatatggagattgtcgctctccacccacaatccacctgtcccggcttcaggttccctttggcctctaaacaagcctttggcgttgaagggccagccacctcgtgcgagttactccaaatccatacccatgagtgcgctgcaataggtgaacccctcccgtcccggcgactgcctcgaacgagcacaggcaggttctagaccgttgtccccagagctttgtgccgtccgcgatggatctgtctatgcgtgaattctcccctttttcgccatcatgcggtttgtgtacccttcaaaaccgctctacaatctcattcacccctggatcacccgcacagaacaaatgcctcatttgtagaacctctccactacagcctaagttgcgcagtgttgaaacaaagcccccagattcatagacatccgaacccggagacaagactccgatgccgatcgtaatctctgatgcctgctacaactccagggtgtgatttcactatctccaggtagacccagttgtcgaggcggtcaaggcaatgatgaattgaaagtcaaccgttccataggatgcccttacggattatctatctttctcggggatacaggattgacgcttagtcggtccaagactagccgttatcacatcctgctgcttcgactcagcatttaggaatgccgcttggcttttcggtggtccgaccgcgcggaacgatagaagagcgcgaagtagagcggactgcaatctaactccaatgctgtttgatcggtcttatctggctggccattgaacatcaatctaaatatccttcaggtccagacagacagacctcgttgaatcgacatccagtcaatatttccacaaggatgccggaacaagtaacggacaaagtagaggctatccccagccgcaaacgagatcccaggattctccgttaagacaaccctgagccaggtactgtgcagttacctgtcttcataccctgccataaaggatgagccgtccaggctacacggtcatcccgtgggagtaaccaggttcaggcaagccacgcccaccacagtggtgaaaccctggctcccccgcggagcacggctaagggtcgactatgatgcgcgacgcatgcagtaatggttgaatcggaatgcaagggatgacactttgagatcgcaacggatgcaatgctactccacttctccccctggatcgaaacattctcatgggcggcatcagccacatccgcggaggccccgggtgaggaacaagaaaaaacaaaggtacacatttaaaagaaggtacatggagttaggcttgccatggacttaaattagtgaattcgtggatgcacctgccggataaagtttccgctctctttattttgctataccttcaattcatctcaactcagccaagcaaatcacaatttcccgaagagaaggaggaaaaggaaagaatgggaagtataggagacctgcccgtgggggtatttcccacgctggtacccccgagctctagtggtcacacagaattccatgcctgggagatttccccggacatcctcacaaatcttctgcaaagcagtatccgaaaggaagttgatctgatagtgctgttgcgtagcatctgggccattgttctccgccaatatgtcgagtcagacgggctgtgcttcaaggcgggaagcatgacttcagcttgctctgagttggatatgctggtctatcgagctggcatctcttcacatgacaccccagaaggtatctggagacagcagcaaataacgaccggtatcagtgcgggaggtcggaactgggaggtgaatactggtgtctttctactcaagctgtgcagtgataggcaatggagagccagagcaatggtaagtggctgacgggcgcattgcagaatatgattatggatgctaacatcgtgagagttgcagcaagctgtggatgcttgcttggttatggaagaagtggatgccaatgctcctcgtctctatttcctggcgaaagcgacattattatccagacagcaggctcagtatgttgcagatactgtcgctcatgtcgcctcagagatcctgcgcaagcccaaccagacactcagggatacggatttctttagtccccaacatgcaccaatcctacacaagtggaaccaccgtaccttctggcctggcgagggcgacactccctcttccatcctggacgccattcgacgacatagtcagcggagccccgacgcgctcgctattgtcgcttgggatggcagtatttcctacggagatctcgaggcacgcagcacgtgtctggcagagtatctgcgtcgtgtcggtgttggcccgggtgtcatggtgcccctgcttctaggccacagccaatgggtcatcatcacccaattggccgtcctcaaagccggagcagcctttgtacccctggagccatcgcatccacaggagagattgcgatatatagtgcgctgtgtgaaagccttcttgattgtggcgtccgaggcgcattgcgctcgggctcaacagctggttgagcaagtcatcccgattaacgagaacatcatgaatacagtgcgtaccgcactcctgtcgacggcgtacataactccgactgcagacgctccggcatatgtccttttcacctcgggcagtaccgggcagcccaaaggctgtgtgatcgaccaccgtgcgatggcccaactcccccatgatggtgtagcagcgtcagtgggacctgactcacgtgtgctgcaatttgcgacctatagcttcaccatggccatctatgagatatattggtgtttgagtaatggcgggacactctgtatcccctcagaccatgacaggttgaacaatcttcctaccgtgatcgaggagatgcaagtcacctgggccgtgctgactccgtcagtactgcgacggctgagccacgataaccccccatctagtttgcagacgcttgccctaggcggagagccgttggctgccggggatatggaggcctgggtgcgaaagctgcaagtgtttttcggttatgcgtctagtgaagggacggcactgaattgcctgacggagctgagcgagcaatcacatgccttagagtatacgcctaccccccgggttcgtcactggatcgttgatcccgacaaccatgataaactcgcggcagtgggcacagttggggagttgatcgttgagagtcccggactcgcccgcgaatacctggacaatccaaccgctactgccgccgcattcattcaaagtcccgactggagaaggtcatttcgattttcccaggatgcgagccaaccgatccgtatgtataaaaccggagacctcttccgctatacggaaaggggcaacctgcagtacgttggccggaaggccacgcaagtcaagatccgcggccaacgtttggatttgggagaagtcgaatacaacgtcagccaacagtgtcctgcacccgcccgagtgattgcagagacaggggtcccgagagatggggcagggacaatgttactagtcgcgtttctttattcggacaactacacattagagcaatcagaaacgacgcagtcagatgaggcctctctatttgctgtcccctccgatcagttccgcgccgacatgaagattttaacacaagcattagaaccattgttaccggcccatatgcttcctggcatctacattcctctgcgacgcttcccatcgacgttgacgggcaaagccgaccgtcgtctgttacgcgaactgatccagcagcacactcgtggcgagttggagcgttaccagtctgtgacgactaataatgtagcgcctccaagcactcgcctggagcgagaccttcacggccttttcgccgaggtactggggataaatgctcaggacttcgggattaatcacagcttcatacgtctgggaggagattctctcgccgcgatgaagctggtcaatttgagccgtaagctaggcctgcgcttgacagtcgcgcagattatggagagcaagactgttgccaagctgagcaacacaacgttggccgacgagtcttctgttagcacgataatccctctgagggatggccctctcgaagccaaacttccgctcgacttttgggaaggtatcgaagaagaacacatcgaatccatttccaactgctccaccatccagcagggcattctattgggacacattcgaaacccagcccactaccataatcgaatagtgtgggaagtccttgagccccctgcagcacgagatatcgatcgaatgcgccgtgcatgggcgcacgtttgccgccgtcaccccatgctacgtacctttttcgtggaagctccagccggaaacagctccctggcgcttcaaatcacgctgaaagtgtcccgcttccgccctgaggatgtggatgtgttgtatgaggagcctgaacaaatgcccagcacgaatcccactctagcctctgaacagcccctacagtggattccccgattacgaatctatgaggctaccggcaatcggctatactgtgcaatcgatattcatcatgttcaggtggacatgatctccttggggataattatccgagatctgaggcgttgctatctggatgagactgagtatgttgcagcgggcgacgtgtctgaacccaacagtgtgtcatacaccgactacacccagtatctcgttgcatcccagtcagcggagagtctcagttactggagaattcgcctagctcatacggagccgtgtatatttccccgcctgcagcagggcccgtttgaggccgcttcgtcagccctttgcagtgtagagctccctctgacgccgatagctgaccatctgcagtcattctgcaaggatacggaagtcaccgtggccacggtgttcaagcttgcctggtcactggtgctaagcgcatatactgggtctcgctgtgcctgttatggttcggtgacggcaatgagagatgtccctttagcgggtgtcgaagatctggtcgggccactaatcaacacgctgccgttttgtgtggaattgaaccctgacgaaagagtgatgaatgtgcttcgacgggtccaaaatctattcctcgaagaactaccacaccgacaagtatccattgcagaacttcaacattccctaaataatagcagcggtactctcttcaacaccacaatgagctttgtcgacagcttagaccctgcagcagattcccaacaccctatacgattggtctcctggtacggaccgactgaatatgacctcgtagttgaagtaactccagggccccccgtctcgtgctgcatcagatactggagccatatgatgtccgactggcaagcatccgctctcgcagatactctagccatgtcggtttcgcagattctacgtggtgcatcttcaggccagtccgtcggaagcctcgatctatgtacggcccgagataagcagaagctcgttgaatggaatgggtctcccccggaggccgtgcgggtgcgtgtgcacgatttgatcaaggctcgatgcatcgagcagccagatgccttggcggtgtgggcctgggatggtgctttgagctatcgggagctcgactgtctttcctcgaatctagctagaaggcttatggcccgtggggtcgggcctgaagcgtttgtcggtatttgttttgaccggtgcaaatggacgttggtatcggttctagctgtcgccaaagctgggggtgcattttgcctgatggactcgtcgcatccgacatatcgcctgcgcgaaatctgtgatgccttgggagcaaatttagtgatcacgacaccaaaacatgtcgcaaaggtatccaaatgcgaacgtcccttgttggtagtagtggagggtgtgtgttctgaaacagacgatttgccaggtggattggggtccgaatatcgtgacacacttcctcgaaatgccctatatgcagtcttcacatccggctcgacgggaaagcccaaaggcgtcgttatcacacacgagaatctggctgcaacaatcaaaaattgccctcaacggttggacctacgaccaggcgatcggtctcttcattttgcgtcttacgcctttgacttcagtatcatcgaggttatagttcccatggtagtgggggcctgcgtctgcattccatcggagcatgaccgtttgaataatttgcccaaggccatggcggaccttgcggtaacctgggcgattatgaccccgacggtgtctcggttactagaacctgccagcctacccacccttcgaactttagtccttggaggagaggcaatcatgccttatgatttcacgacctggcagggttacacgaccctcatcagcgcatatagtccggctgaatgcacgccgattggactttgcactgtggttcaggcggatgatccgaactgtttgggcaagccattcacttctatgtcgccctggatcgttgacccagaaaatgttcagcggttggtcccggtcggtgctgtaggagagctcgtcatagaagggaccgtcgtcggtcgaggctatctacacgatgcagagcaccgtgatatagtctcctcaccgttcatccctccgactcagtggctatcccaatatcgaaccatcgacgtgactaacccttcgcgcttatatcgcaccggggaccttgtccaatttactgaggacggggcggtacgatttatcgggcgcaaggacttgcaggtcaagatccggggccagcgactggaattgggcgaagtggaatctcgactccgaagctacctcccttgggctggcgcaattgtcgtcgaagctgttgtcttgaaatcccccggtggtcgcgcagtactggtcgcctttatatccattaactccccagatgttacagacaacgccgagacagtgtgcgagatagccggatcgtttgataatgatgacaatagtgtatatcagcgtgatatcgataaggctctttcacatcttggggatgagctaccgaactggatggtcccttcggtggttctgaaggtgcagggcatcccaatgaccaaatccggaaaagttgatcgacgcagactgcgacaactagctaccctgattccccgagagacgctaggggcctctaatgtccatagttctcttcgtcaagctccagtcaccgaagaagagagacggctacagatggctttcgcgaacatcttgcaaatgcggcctgaggagatattcgctgacagtcactttttccaacttgggggtgattctgttggagccatggagctggtggcagcggcgaggctacagaatatgggaatcagtgtcagtgagattttccagcatcctacattgagtgagctggcagcggtggcaaccaagaccatggatgaggagacttctgagattccgcccttcagccttctacccagtgactacgaatcggatatcatctcatccgctctagagcaatgtgctctatcgctgaatgacttgggtgatatctatccgtgtaccgcctttcaggaagggttaatggcccttgccagtcaaaaagctggcaagtacgtctgtcagtgtctatttgagctcggacgtgatgttgagataaataaattgaagaccgcgtggcaagcaacagtgactgccaatgatatcctccgcacccggattattcacgttcacccgcacggtaccttccaggtggtcctgacgccagccgcagctccgattttgtggcacagatatgagaccgtcaatgaatggcgcaagaaggatatggaactgaacatggaactgggaaccacattggctcgctttagcatcctcagctcggcccagggacagacactcgtaggtgtctctctccatcatgccatttacgatggcgtctccctgccccgactctttgaccaggtgcaaagggcatatcagaatgaacgtctacccctcaataaattcacaccctttattcgctctctaatcttgcagaatcctaaggatgttgaagaattctggcgcaccgagttccatggtcttcagacttcggtattcccaggtttgcccgagcctggatttgtgcccaaccctacagcgagcgtggaaaaggagatcaggctcccacggccaccgcacctgccaagtgttaccctttcaacagtaatgaggctggcatgggcactgctggtatcatattatacagattctgaggatgtggtctttggcgtcaccgtcagtggtcgagcgcggtctgttcctgggataaaccttctaactggcccttctatggccactgttccattccgcacgcgaatttgtcgtgatagtctacttctggacgctctgcgtgatgctcaggaccattccatgcgcatgattccctttgagcaggcaggtctgcaaaggatccgagagctcagcgatgaagctagcgttgcctgcggatttcagtcacagttggtcattcaacatggcgagcatagccaggcctcccctaacatgatgatactgcgtgatcagtttgcggatcatgcggcgtttctcaactacgcactggttatattgtgcaccccatcaacggcacatcaaaccgtacgcgtgaactttcagttcgatccgcaaattgtactgccggcggtcgcagatcgactgctgagccaatttgcccatatcgtggatcagatgtgtgcgccatctagctacaacgctaggctcgggggcctcgaaacaataactccccaagattggacctcgctgcggcaatggaacggcagcctaccagccgcataccctcatccgcttcatcatctcgtactgtcgcaggcggagaccacacccgacaggcgggccgtggagtcatgggatggaaccttgacatatgctgaattgaatgatctctcgggaaagctagggcagcatctgttgaaccgtggactgaaacagggttcacgggtggttctcctttttgaccgctccctcatatcggttgtgacaatgttggcagtgcttcggtcaggaggcatatgtgtcaacattgacccatctctaccgcagactcgcattacccagacaatacaccaagcacggccctcagtggcattggtatcatctacatatcagtcgcggctggcagatgcattgccggttcctgtcctcacgattgcactggataccataccacgaagcgcaaagaacatcccttggccacttgtgcgctctactgaccttgcatttattctcttcacttccggtaccacgggaaagcccaaaggcatcatggtagaacatggaaattgcgctaccgacatttttcactacagtgctatcttggccgtcaccccggaaataagaacactacatttctgtagctatgcatttgacttgagtatctacgaggttctgacaccctggatgcacggcggatgtctgtgcatcccatcagagtctgcacggctttcagatttgcccggagtcatccagaaataccacgtcaacttcgcaatcctgactccatccgtggggagtgcgctacatccaagtgaccttcccagcctgcaaaccctcatcctgggtggtgaagtgatgcctgcggtgatgttcgaccgctgggcctctcatgtacgcttgatcaacttgtatggcccagcagaggccacccagtgtgccgctctccacctgaaacccacagacgagtttgtgccaggacttattggtgctatggttggcgcctcgggctgggtcacggtccctggcagtccaaattgcctcacccccattgttgcggtgggcgagctcctgatagaaggcccagcggtaactcggggctattttgacgaaatggaacagacgcaagcatcatatatcgatccgccagcctggttgcaggagtttcgcgggcctgctgagcctggccgcctcttctgctctggagacctggtgcagtatgtacctaaccggccaggttggctgcgctacattggacgcaaggataagcaagtcaaaatccgtgcacaaagggtcgacctgacggaagtcgagcaccatgtcgatgagctactcccaccaggcagtcaggcaattgccgaggtcctgttccagcactcgtctccccgccaatcgagccagcttgcagtattcttggcctttggtgaacagttaaccaacaaaatggacatcatatgcgccctcgatgagccattcagaagattaatagctgaaatccacccacagcttcagaaaaggctcccttcttacatggtccccaccctcttctttccggtatctcacgttcctcaaacacccaccggtaagaccgatcgaaatcggttgcggcagttggtagaagggtggacgaccgaacagctgctgccatatcatccgttcagtacagattcagcgcgtgcgccagtagagacggctgaggagcgcatctggcagcacatgtggtgcgaggtactctgcatacgtcccgagaatatcgccagaactagtcatttctttcaccttggcggtgagtctgttagagcgatgaggttggccgggttggcacaacgtgagggatggatcatttccgtgccagatattttcgctcatccgacgctatcggaaatggcgagtctcgctgtaccctcccccaagggtgtgccggttccatctccagaccgtttcagcctggtaggaagcggaaggcgggcatcatatctggttaatatggcgactcaccagtgcaacgtcaccaaaagtgagatagaggatatatatccttgtaccccgctccaggagactctcatagcctcaacggtacaaaaaggaggctcctaccaagcgctggaagcctttgatctgatagccgatgtggatttggaacgcttggaaatggcgtggcaaaagacagcggccgatcatgctatcctccgcacgcgaattatgcaagactataccggcgaactgtttcaggtggtagtcaaaggtccgttagcatggaccgcggaacaagcggacataaaccctgagaatgggttactgcatttccagcgtaccatgggcattgggacacccttgattcatctagtccttctacaatctcccggatccacgatacccgatcgtctcttgctctcgatacatcacgcattgtacgatggatggtccctgcccctgttgctcgaggaggtcaatcagaaatacatcggcccatatcggggccaagacacaaccgtgcctttcaacgtatttgtctcgcatgtaattaaatccatggacaggtgttgtcatttttggaaacaggagttggaaacgaagacagaagctcgactatttccacgtttgccggacggggcatacgagccacacccacaggctattttgcaggaccaagtctttgttagcccgacgcggaatgaatctgagataaccctcgcaaccatggtccaggcatcttgggcattgacagtgagttgctacttgaacgcaagcgatgtagggttcgggatcaccacctctggacgagctgcccctgttccgggaatcgatcgactgttgggacctacgctggttacattgccccgacgcatacatatccagaacaccctggatatcaaacttttcctacggcaactacagcagcgctttacggagcagtccaagtatgaacacattggactgcagcagattcgccagctagggccatcggcggccagcgcgtgtcgcttccagactctcctagtcattcagcccgaccagccaaagcgccagctggcttgggctggaaaccaccagagtgcggccgaattgacgcagtttagcaatgttgcgttaaccctgatctgccagctcccctctccctcctcgacgtccattggcctgacagcagtttacgaccctcgagtactggcacccgcacagatgcagcgggttctgtcgcaagttggccatgtcttcagagagttacaggatgctccagacggtgttcccatcgcctcgctcaatatgctgaaccccagtgactccgcagaactgcaacagtggaataagctcactgttcctactggaaagcatcaagatcaagaatttgtgcatgacatgatacggcggcaatgccagcttcaaccagacgccgtagccgttgaggcatgggacggaagcctcacttatgaagagctggattcctacacggagtacctggctgcgaaactgcagctatgtggtgttcgcaacgaccacttcattgctctctacttcgagaagtcatgttggaccattgtcgcccaactggcggtcctgaaagccggaggggccctagtgatgctagagccttctcatcccgttgatcgccgtcgggagatttgccagactttggatgtcatgttaatccttggtcctcctcacctcactcattcgttggaacaggagctcaatatcaaggtactacctatcagcaaggctcatctcaaagcgtcggatggggaacatctatcagtcgacagtcatatacagtctcataacctcatgtatgccatcgctacatccgggactactggttgtcctaagctcgcattggttcatcatggcggttttgttgccactgcaaggaccttggttgataggctcctcttactggcatcgtctcgggtgcttcaattctctagttacggattcgacgcaagcttagtggaacaactgcttccgttaattgtaggaggctgcgtctgtgttcccaccccctttgaccgtgataaccgcctagcgttcacgatggcgaccatgaagatcaattggatggttgcaccagcatcagtgattcacctactttcacctgatacggtcccaacactacagacattaatatctgcgggtgagccattgcagcaaagtataatcgatgtgtgggccactcgagtcaacctcataaatgcatacggcccagcagagtgcagtatggtgtgctcggtcaacccaagcgtaaggccgggaaccgatccgaacaatatcggatacccaattggtggcacctgttggatagtagacccaaatgatatcaacacccttttgccaattggtgctgaaggagaactcctggtggaagggccgaacgtcggtgtcggatatgcgaaagaccctcggcgcacaagagttgcattttcatcatcaccgcctcactggctccgctccattcacggagaatcagtccacactcgaatataccgcacaggagatatcgctcgatataatcccgacggatctgtgctttacgtgggccgtaaggattcacaaatcaaattacatgggcagcggatcgagctcgccgaggtggaacatcatgtcaggctatgtttcccaggcgccatccaggtagttgttgagatggtcaagtttgacgattttgaaactagctccctcgttgccctcatcgtcgtgtctggctcaggctttccagcgtctggatcaaacatcctgctcccaacaaccacaaatttcctcaacaatgttcaacacgcggaagcactcctgcaggatcgtatcccaccctatatgatcccgacgctgttcgtaccggtggcacagattcccttcaataccaatggcaaggcagatcgtgctcgtctgagaacctcggttgcttctctgtccatccatgatcgtataggctatcgctccacggccacaacaaagcctaacacagatctagaaattgtgcttcatggaatctggtcccgtgttttgcggatctcacctcagaagcttggcatccatgaaagcttctttcgggtaggcggcaattctattagcagtatgcaactagcggcgcagtgcaacgaggctggccttccaatatccatccaggatatcttccgttgccgaacaatttcgcggttggcgtcatcattcaagggtcatcctgtccaggcggacagatctttagaagcacatagccaggatggatcactgggcccagtgcagcggctgctgcctgaagtagggcaccccaaggctccagtggattctactcttgccgccttcactgatggccagttcgaggagataaataacggcatcccggctggatatgaagggcagatacaagatatctacccctgctcccatgcacagcagggcatgctcatcagcaacacacgcaactccagcctctatcagcaagtctatcgctttgaagtggttagaggttatgatgcgcccaacgttgactgtcagcagttggtaagggcgtggcatgcggtagtcaagcgacatggagccctgcggaccgttttccttgatataccagggagagggttccaccagatcgtgctcgtcaatgcaatagacaatgtcataattgcggctgacggcaaccatagcagtacatgtacccaaaagagacctggtacacaagacctgtatggtcctttaccaactctaattattcaccaggagtatgatgagcggctttggatcgaactgcatataagtcatgctcttctagatggagtgtcactgcgaatcatcgaacaagacctcgtgaaagcatactacaacaacctaccctcttcattacctgactatcgggattacgtcacctatctgcgggcaaaaggagatacggaaatgtcattgagctactggaaaaaatacctggagggtgcgcagccctgcctctttccacgcctccgtgactctacagcagcagtgacagacgtgtcggagccaaaggcgacagtcgacttcgtgtcgcttgacttgggccctccgaagtctcttgatcagttgtgtgagactcattgcctgagccttaccgctatcttgcatgtagtttgggccattgtgctgcagcaatataccggaacggacagcgtgtgctttggatatgccacatccgcgcggcatgtccccatccctcatgtggatgaaatagttggtccaatgatcaacacgctgcccagtcaaatccaactctctagggattcatcagtactgtccactttacaaaagtacaccgttcacttcatgtcctgcatggagcatgcctacgtctcacttggacagatattacactcggctatgtccagtacacaatcacccttcaacacaatgataactattgttgagactggagatcgtagagacgacgctgatggatcctgcttatcgttggtttgtatggatggacatggggagacagaggtatgcatccccgtattcctacacggcgaacctgacgactgactgctcccttcacatccctcagtatgcgttggccttgactgtttccaaagcatcgagccgcatggatttgcacctttcataccaaacatccatggtcaatgcttctcaggcccatgatgtgtgcctgatgtttcaaaaagtcctgtgtgaggtcttggagtggcccacggccaagattggtgccattgatgccctgaatatgggtcagagacagcgcatggaatcgaggcagcctaccccaccggctgctgcaaatacattgatatacgaaaccatcaatcggcgatgtgcagagcaaccatcctcatcagccgtctgtgcctgggatggtgaatttacctacggggaaattgatcagctctcatcagtattggcgggagagatccttgcccatggagttaaaccggaggacccggttttggtatgccttgaaaagagccgctgggttccggtggttatgctggcagtctggaaagccggggcatgcttaattcttctggatgccacccatccaactacccgattgcatatgattgccaagcaatctgccgcatcactggcaattgcaaatagaagtacgcgctccaaagcaaacatcctgtgctcacgagtattgcaagtcgatgatgaccgcttgtggactcgacatgttaactcctcgcgggccgagatggttcatgttgacggacacagcgctgcatacattatattcacatctggctcgactggaacacccaaaggggctgtgattgaacatgcttccctttccattgcgtgggagaccctcattactcgactacagttaaacccgacatcgcgtgttctacagtttgcctcccattcctgggatgcggcaatcatcgatgttatggccgcattgatgtcaggaggctgtctctgtgtaccctcggaaaacgaacgtatggggcatttggccttagctgcgaatcgtatgcgagccaattggatgctactgaccccaactgtcgcccgtcagcttactcctagcgagtttctttacctcgaaacgctagtccttggcggcgaacgggtcaatacaacggacattgaagtctggcatgataaagtctgtctcctgagcgcatatggcccagcagagtgcacgcaaatcacgagcgtgacgaggccgttagatatgacctgtgatgcgcggaacatcggcgtcccaaatgccagcgctggatgggttgtacgtccggacgaccctgaacagctcgtccccgacggagccattggagagttacttattgagggacccattgtgggccagggctatttaaatgagcctcagcgtacctatcaagccttcattgaggcccccagttggttgcaggccattcgctcccccggtaccattcgggtctacagaactggggacctggttcggtttgcagctgacgggtcactcatctttgtcggacgcatggatgaccaggtgaagctacacggccagcggttagagctgggtgaggttgaacatcacgttcagcaggctttcgctgcatcgcttacggtgattgatctcatccaacccaaagaggagcaacaaatgggtccgttcctcgcagcatgtatcttctctcccggccatgcttgtaaatcaccatctcatgccggcatttgggagcccccttcagacacctttcgaaagaaagttcaagaggctagaacagcattgtatcagagcctgccttcatacatggtgccttctgtgtttctgccattggcatacctgcccaaatcaacgacaggaaaaattgatcgaaagcgtctccgcaattacatccttgacatgtcccaagaggaactcattacttatagctctcccgatgtcaactgggtggcctctgtcttaaccctcatggagacgcgcttgcaggatcatatttccagtatcctgcataaacaaccttggcaggtttcacccgatcaagatctctttcagctgggaatggattcagtgctagccatggccctaattgcaaggctgtacaaggacggcctcaagctaacggtcagggatatctttgagcaacctcagctgcgtaacctggctcttgtggtgcgagagacgttgcggccagatcaagaaggtgtcaggaaagcacacagccgcagcccccttctgcactatgcgaaggagattgctgatgagtggaagatggctttaacctccattgagcacattttgccaactacccgtttccagcgagagagcttggaggcgcgacacaaagtgtactttattttccattttcatggcaagatcgactgtcagcgtcttcagcatgctgtgcaggctgctgtagacaaatacgccatactgcgaacggtcttcattccttgggacgagtctacagttcaaataactttaggtgacgccactgtaccggtggaaatcacgacgaccgatctgaatccagtagaaatagcaggatccatttgccgcgaggattcatcagcacccgttgctcccggcaaactacacacccagcttcgcttgatcatggggtccaaccgtgattcaatggcccttcggttgtcccatgctcagtatgacggcatcagcatgcctcgcctgttcacggacatcgcccgggcatatcaggggataactttaagtcccgctaaggtggactttccggaatacctgcacagccgcatctataatattccttcgcaggcatacaagttctggcgcgacttgctccgaggttccagcatgacctatctacgttctgaatcttcatcagggtctccgccttcccataatcggggaagccttataacgagcaccacagaggtctcatacccgccagcccccgctggaaccacgatggccaccgtcgccaaggcagcttgggccctctgcctggcacacatggctggcactcacgacatcgtattcggtcagctcgtcaacggccgaaacctggagctgccagaggccgaaacggttgtgggtgcctgtgtcaattacgtcccagtccgtgtgactctccaggctgactggaccgtgtcaagcctcctccatgcggttcatcagcagcaaacccgcagcatggccttcgagacactcgaatatgacgagctggtggcgcagtgtacctcctggccggcagacacagacccgggtaccgggatccactacgtgaacatccccgatgcgtttgctggtagcggcctgcctggggtggggtcggactatgagacctatgtatcccgcttgccttattatcatccccgtgtgacctgtagtcccctctcgaagggaatacttgagcttacgctttccgtctcggatcagctgtgggatcagaatcaggcggatcagactctgcatctgtttgggcagactgtggtacgcattctggagaacccaacagggcttgcttgtgatgttcttaaagcgctggtgtagcttcctcccacagtgtatagtaatggattgacccagacagatggttgacagtaatttaatgtttaataattacagccggatgttctcaatcaatttatgttgtagactagacaaaatcttgttacttttactagttatgctatgcttgacactgctacaagattggctactgctcctagcaattatggtatctactacggctgtccactttctccgcactttcctctccgaaccattttgttttactcccaatgtcgtcaacacctagatacttcttaagcgcggcccttcactaaaaggggtcatctatgtgagttagtgaccctcattgtcgctactactagagtttcgaacgcgcggacatgatatggagagggttgtatctatgctggtgaattcgcaaggattgagcagtttcctcccttgaaatcaacatttccccttgagagggtccacaggagagcagaggtagatttatgcttaagactagaatactctctttcctcggggtatgccagatctagcgggagagttcagtcaatcaaggtgagacctgcatccgcagacggtgcgcagcattgtgttgctctgcatggccgatcatctctcgggtatgcgtcatacctttgtcattggacatcgtgcagatgagttaacaggtgtacttggcaggttcatggaagttgtcgagaaaaaggcggtcaatggatatatgtgaaataggtaggttagatttattggcatgcaatacagccttgtgggctactcgcaccaagagtccggatcttgcgggccattgatggtggtggcgtttcatatgacatgacacgtcccgccacatgaaagtcaatcccatcgggttagagcgagatgcaaagaacaagtttcgagttctgacaaagcaacccttggcagaactcgatgatatcaggaaatgatccattgtttacctgtaggttgctctcttcgggccattcagtttgatctaagagcggtatatgtatatatccactcatccagtgacgactctgtgcaacatgctgctatggtagaccgctggctactatcggaatcgaagatcttatggtacttgtgggtcattcattggtccacccggggttagcatcagtcgatcgatcgctgtgggccgggtatctccgggtcgatcgttggtcagtgagagtcatctgcaacgggtcaaaggattgttcgggagccaaaatgaagatggagagggaggacagcctgggacgagcgagagggcctccctcgagacggagtcagcgatagctccgccagccggcgcgaattgggttccatccaggatccacccgtgccgggaaagtcaacatcttcaccggcagagaggcgctgaattcttcacgcgactgagacaactcaactgtatgaatggtcatagggctactctctctgcaatttggaaccaattagatgctccatcacaacttctgaactgttggaaggatcggggatgacagcacatgagggagccggagttgggcggccacggtttagcgagcgggatcgaccggcgagtggccctgatggatcacaatccacaagtcatgaaaggccattgccggcagtgcactgtcccacgtgcaaggcttgagtagcatccagcccaatcacgctttgctggtgaaatcgtgccgaaccccattcgcagcaaggggaggtggtgttgctcaggggaaaaccttgttggaaaggtaactcggagaagattcgccttgtgggggcggttttgctggtcctgcatatccacccatatataaggggcaggatatccagactgtgggcgattcttctccctaaccttttgcacagtcaatacaatcaacttaaaatgtacaccaagttgtccctgtctttcggcctcttggccacggcaacgctcgctctggccgagccgaccgtctacctgattcgccacggcgagaagcccagcaacgggagcaccggcctcaatgctgtgggttttgagcgggccgactgcttgaagactgtattcggcccggattccaactatgacattggatatatcattgcagaacaacccaagtcaggtgcgtcgattctcgagtttgctttcgggatccaatacgtcagggattgacagactcgcagatggcaaacgcgaccgcccgtacgagacggttcttcctctcgccgaggaactggggctcactgtcgatacgtcctgctcgaagaaggacaccaagtgtgtcaaggacctggtgaaggactacaccggc

SEQ ID NO: 16 - DNA, 17202 bp, Aspergillus niger
atgggaagtataggagacctgcccgtgggggtatttcccacgctggtacccccgagctctagtggtcacacagaattccatgcctgggagatttccccggacatcctcacaaatcttctgcaaagcagtatccgaaaggaagttgatctgatagtgctgttgcgtagcatctgggccattgttctccgccaatatgtcgagtcagacgggctgtgcttcaaggcgggaagcatgacttcagcttgctctgagttggatatgctggtctatcgagctggcatctcttcacatgacaccccagaaggtatctggagacagcagcaaataacgaccggtatcagtgcgggaggtcggaactgggaggtgaatactggtgtctttctactcaagctgtgcagtgataggcaatggagagccagagcaatgttgcagcaagctgtggatgcttgcttggttatggaagaagtggatgccaatgctcctcgtctctatttcctggcgaaagcgacattattatccagacagcaggctcagtatgttgcagatactgtcgctcatgtcgcctcagagatcctgcgcaagcccaaccagacactcagggatacggatttctttagtccccaacatgcaccaatcctacacaagtggaaccaccgtaccttctggcctggcgagggcgacactccctcttccatcctggacgccattcgacgacatagtcagcggagccccgacgcgctcgctattgtcgcttgggatggcagtatttcctacggagatctcgaggcacgcagcacgtgtctggcagagtatctgcgtcgtgtcggtgttggcccgggtgtcatggtgcccctgcttctaggccacagccaatgggtcatcatcacccaattggccgtcctcaaagccggagcagcctttgtacccctggagccatcgcatccacaggagagattgcgatatatagtgcgctgtgtgaaagccttcttgattgtggcgtccgaggcgcattgcgctcgggctcaacagctggttgagcaagtcatcccgattaacgagaacatcatgaatacagtgcgtaccgcactcctgtcgacggcgtacataactccgactgcagacgctccggcatatgtccttttcacctcgggcagtaccgggcagcccaaaggctgtgtgatcgaccaccgtgcgatggcccaactcccccatgatggtgtagcagcgtcagtgggacctgactcacgtgtgctgcaatttgcgacctatagcttcaccatggccatctatgagatatattggtgtttgagtaatggcgggacactctgtatcccctcagaccatgacaggttgaacaatcttcctaccgtgatcgaggagatgcaagtcacctgggccgtgctgactccgtcagtactgcgacggctgagccacgataaccccccatctagtttgcagacgcttgccctaggcggagagccgttggctgccggggatatggaggcctgggtgcgaaagctgcaagtgtttttcggttatgcgtctagtgaagggacggcactgaattgcctgacggagctgagcgagcaatcacatgccttagagtatacgcctaccccccgggttcgtcactggatcgttgatcccgacaaccatgataaactcgcggcagtgggcacagttggggagttgatcgttgagagtcccggactcgcccgcgaatacctggacaatccaaccgctactgccgccgcattcattcaaagtcccgactggagaaggtcatttcgattttcccaggatgcgagccaaccgatccgtatgtataaaaccggagacctcttccgctatacggaaaggggcaacctgcagtacgttggccggaaggccacgcaagtcaagatccgcggccaacgtttggatttgggagaagtcgaatacaacgtcagccaacagtgtcctgcacccgcccgagtgattgcagagacaggggtcccgagagatggggcagggacaatgttactagtcgcgtttctttattcggacaactacacattagagcaatcagaaacgacgcagtcagatgaggcctctctatttgctgtcccctccgatcagttccgcgccgacatgaagattttaacacaagcattagaaccattgttaccggcccatatgcttcctggcatctacattcctctgcgacgcttcccatcgacgttgacgggcaaagccgaccgtcgtctgttacgcgaactgatccagcagcacactcgtggcgagttggagcgttaccagtctgtgacgactaataatgtagcgcctccaagcactcgcctggagcgagaccttcacggccttttcgccgaggtactggggataaatgctcaggacttcgggattaatcacagcttcatacgtctgggaggagattctctcgccgcgatgaagctggtcaatttgagccgtaagctaggcctgcgcttgacagtcgcgcagattatggagagcaagactgttgccaagctgagcaacacaacgttggccgacgagtcttctgttagcacgataatccctctgagggatggccctctcgaagccaaacttccgctcgacttttgggaaggtatcgaagaagaacacatcgaatccatttccaactgctccaccatccagcagggcattctattgggacacattcgaaacccagcccactaccataatcgaatagtgtgggaagtccttgagccccctgcagcacgagatatcgatcgaatgcgccgtgcatgggcgcacgtttgccgccgtcaccccatgctacgtacctttttcgtggaagctccagccggaaacagctccctggcgcttcaaatcacgctgaaagtgtcccgcttccgccctgaggatgtggatgtgttgtatgaggagcctgaacaaatgcccagcacgaatcccactctagcctctgaacagcccctacagtggattccccgattacgaatctatgaggctaccggcaatcggctatactgtgcaatcgatattcatcatgttcaggtggacatgatctccttggggataattatccgagatctgaggcgttgctatctggatgagactgagtatgttgcagcgggcgacgtgtctgaacccaacagtgtgtcatacaccgactacacccagtatctcgttgcatcccagtcagcggagagtctcagttactggagaattcgcctagctcatacggagccgtgtatatttccccgcctgcagcagggcccgtttgaggccgcttcgtcagccctttgcagtgtagagctccctctgacgccgatagctgaccatctgcagtcattctgcaaggatacggaagtcaccgtggccacggtgttcaagcttgcctggtcactggtgctaagcgcatatactgggtctcgctgtgcctgttatggttcggtgacggcaatgagagatgtccctttagcgggtgtcgaagatctggtcgggccactaatcaacacgctgccgttttgtgtggaattgaaccctgacgaaagagtgatgaatgtgcttcgacgggtccaaaatctattcctcgaagaactaccacaccgacaagtatccattgcagaacttcaacattccctaaataatagcagcggtactctcttcaacaccacaatgagctttgtcgacagcttagaccctgcagcagattcccaacaccctatacgattggtctcctggtacggaccgactgaatatgacctcgtagttgaagtaactccagggccccccgtctcgtgctgcatcagatactggagccatatgatgtccgactggcaagcatccgctctcgcagatactctagccatgtcggtttcgcagattctacgtggtgcatcttcaggccagtccgtcggaagcctcgatctatgtacggcccgagataagcagaagctcgttgaatggaatgggtctcccccggaggccgtgcgggtgcgtgtgcacgatttgatcaaggctcgatgcatcgagcagccagatgccttggcggtgtgggcctgggatggtgctttgagctatcgggagctcgactgtctttcctcgaatctagctagaaggcttatggcccgtggggtcgggcctgaagcgtttgtcggtatttgttttgaccggtgcaaatggacgttggtatcggttctagctgtcgccaaagctgggggtgcattttgcctgatggactcgtcgcatccgacatatcgcctgcgcgaaatctgtgatgccttgggagcaaatttagtgatcacgacaccaaaacatgtcgcaaaggtatccaaatgcgaacgtcccttgttggtagtagtggagggtgtgtgttctgaaacagacgatttgccaggtggattggggtccgaatatcgtgacacacttcctcgaaatgccctatatgcagtcttcacatccggctcgacgggaaagcccaaaggcgtcgttatcacacacgagaatctggctgcaacaatcaaaaattgccctcaacggttggacctacgaccaggcgatcggtctcttcattttgcgtcttacgcctttgacttcagtatcatcgaggttatagttcccatggtagtgggggcctgcgtctgcattccatcggagcatgaccgtttgaataatttgcccaaggccatggcggaccttgcggtaacctgggcgattatgaccccgacggtgtctcggttactagaacctgccagcctacccacccttcgaactttagtccttggaggagaggcaatcatgccttatgatttcacgacctggcagggttacacgaccctcatcagcgcatatagtccggctgaatgcacgccgattggactttgcactgtggttcaggcggatgatccgaactgtttgggcaagccattcacttctatgtcgccctggatcgttgacccagaaaatgttcagcggttggtcccggtcggtgctgtaggagagctcgtcatagaagggaccgtcgtcggtcgaggctatctacacgatgcagagcaccgtgatatagtctcctcaccgttcatccctccgactcagtggctatcccaatatcgaaccatcgacgtgactaacccttcgcgcttatatcgcaccggggaccttgtccaatttactgaggacggggcggtacgatttatcgggcgcaaggacttgcaggtcaagatccggggccagcgactggaattgggcgaagtggaatctcgactccgaagctacctcccttgggctggcgcaattgtcgtcgaagctgttgtcttgaaatcccccggtggtcgcgcagtactggtcgcctttatatccattaactccccagatgttacagacaacgccgagacagtgtgcgagatagccggatcgtttgataatgatgacaatagtgtatatcagcgtgatatcgataaggctctttcacatcttggggatgagctaccgaactggatggtcccttcggtggttctgaaggtgcagggcatcccaatgaccaaatccggaaaagttgatcgacgcagactgcgacaactagctaccctgattccccgagagacgctaggggcctctaatgtccatagttctcttcgtcaagctccagtcaccgaagaagagagacggctacagatggctttcgcgaacatcttgcaaatgcggcctgaggagatattcgctgacagtcactttttccaacttgggggtgattctgttggagccatggagctggtggcagcggcgaggctacagaatatgggaatcagtgtcagtgagattttccagcatcctacattgagtgagctggcagcggtggcaaccaagaccatggatgaggagacttctgagattccgcccttcagccttctacccagtgactacgaatcggatatcatctcatccgctctagagcaatgtgctctatcgctgaatgacttgggtgatatctatccgtgtaccgcctttcaggaagggttaatggcccttgccagtcaaaaagctggcaagtacgtctgtcagtgtctatttgagctcggacgtgatgttgagataaataaattgaagaccgcgtggcaagcaacagtgactgccaatgatatcctccgcacccggattattcacgttcacccgcacggtaccttccaggtggtcctgacgccagccgcagctccgattttgtggcacagatatgagaccgtcaatgaatggcgcaagaaggatatggaactgaacatggaactgggaaccacattggctcgctttagcatcctcagctcggcccagggacagacactcgtaggtgtctctctccatcatgccatttacgatggcgtctccctgccccgactctttgaccaggtgcaaagggcatatcagaatgaacgtctacccctcaataaattcacaccctttattcgctctctaatcttgcagaatcctaaggatgttgaagaattctggcgcaccgagttccatggtcttcagacttcggtattcccaggtttgcccgagcctggatttgtgcccaaccctacagcgagcgtggaaaaggagatcaggctcccacggccaccgcacctgccaagtgttaccctttcaacagtaatgaggctggcatgggcactgctggtatcatattatacagattctgaggatgtggtctttggcgtcaccgtcagtggtcgagcgcggtctgttcctgggataaaccttctaactggcccttctatggccactgttccattccgcacgcgaatttgtcgtgatagtctacttctggacgctctgcgtgatgctcaggaccattccatgcgcatgattccctttgagcaggcaggtctgcaaaggatccgagagctcagcgatgaagctagcgttgcctgcggatttcagtcacagttggtcattcaacatggcgagcatagccaggcctcccctaacatgatgatactgcgtgatcagtttgcggatcatgcggcgtttctcaactacgcactggttatattgtgcaccccatcaacggcacatcaaaccgtacgcgtgaactttcagttcgatccgcaaattgtactgccggcggtcgcagatcgactgctgagccaatttgcccatatcgtggatcagatgtgtgcgccatctagctacaacgctaggctcgggggcctcgaaacaataactccccaagattggacctcgctgcggcaatggaacggcagcctaccagccgcataccctcatccgcttcatcatctcgtactgtcgcaggcggagaccacacccgacaggcgggccgtggagtcatgggatggaaccttgacatatgctgaattgaatgatctctcgggaaagctagggcagcatctgttgaaccgtggactgaaacagggttcacgggtggttctcctttttgaccgctccctcatatcggttgtgacaatgttggcagtgcttcggtcaggaggcatatgtgtcaacattgacccatctctaccgcagactcgcattacccagacaatacaccaagcacggccctcagtggcattggtatcatctacatatcagtcgcggctggcagatgcattgccggttcctgtcctcacgattgcactggataccataccacgaagcgcaaagaacatcccttggccacttgtgcgctctactgaccttgcatttattctcttcacttccggtaccacgggaaagcccaaaggcatcatggtagaacatggaaattgcgctaccgacatttttcactacagtgctatcttggccgtcaccccggaaataagaacactacatttctgtagctatgcatttgacttgagtatctacgaggttctgacaccctggatgcacggcggatgtctgtgcatcccatcagagtctgcacggctttcagatttgcccggagtcatccagaaataccacgtcaacttcgcaatcctgactccatccgtggggagtgcgctacatccaagtgaccttcccagcctgcaaaccctcatcctgggtggtgaagtgatgcctgcggtgatgttcgaccgctgggcctctcatgtacgcttgatcaacttgtatggcccagcagaggccacccagtgtgccgctctccacctgaaacccacagacgagtttgtgccaggacttattggtgctatggttggcgcctcgggctgggtcacggtccctggcagtccaaattgcctcacccccattgttgcggtgggcgagctcctgatagaaggcccagcggtaactcggggctattttgacgaaatggaacagacgcaagcatcatatatcgatccgccagcctggttgcaggagtttcgcgggcctgctgagcctggccgcctcttctgctctggagacctggtgcagtatgtacctaaccggccaggttggctgcgctacattggacgcaaggataagcaagtcaaaatccgtgcacaaagggtcgacctgacggaagtcgagcaccatgtcgatgagctactcccaccaggcagtcaggcaattgccgaggtcctgttccagcactcgtctccccgccaatcgagccagcttgcagtattcttggcctttggtgaacagttaaccaacaaaatggacatcatatgcgccctcgatgagccattcagaagattaatagctgaaatccacccacagcttcagaaaaggctcccttcttacatggtccccaccctcttctttccggtatctcacgttcctcaaacacccaccggtaagaccgatcgaaatcggttgcggcagttggtagaagggtggacgaccgaacagctgctgccatatcatccgttcagtacagattcagcgcgtgcgccagtagagacggctgaggagcgcatctggcagcacatgtggtgcgaggtactctgcatacgtcccgagaatatcgccagaactagtcatttctttcaccttggcggtgagtctgttagagcgatgaggttggccgggttggcacaacgtgagggatggatcatttccgtgccagatattttcgctcatccgacgctatcggaaatggcgagtctcgctgtaccctcccccaagggtgtgccggttccatctccagaccgtttcagcctggtaggaagcggaaggcgggcatcatatctggttaatatggcgactcaccagtgcaacgtcaccaaaagtgagatagaggatatatatccttgtaccccgctccaggagactctcatagcctcaacggtacaaaaaggaggctcctaccaagcgctggaagcctttgatctgatagccgatgtggatttggaacgcttggaaatggcgtggcaaaagacagcggccgatcatgctatcctccgcacgcgaattatgcaagactataccggcgaactgtttcaggtggtagtcaaaggtccgttagcatggaccgcggaacaagcggacataaaccctgagaatgggttactgcatttccagcgtaccatgggcattgggacacccttgattcatctagtccttctacaatctcccggatccacgatacccgatcgtctcttgctctcgatacatcacgcattgtacgatggatggtccctgcccctgttgctcgaggaggtcaatcagaaatacatcggcccatatcggggccaagacacaaccgtgcctttcaacgtatttgtctcgcatgtaattaaatccatggacaggtgttgtcatttttggaaacaggagttggaaacgaagacagaagctcgactatttccacgtttgccggacggggcatacgagccacacccacaggctattttgcaggaccaagtctttgttagcccgacgcggaatgaatctgagataaccctcgcaaccatggtccaggcatcttgggcattgacagtgagttgctacttgaacgcaagcgatgtagggttcgggatcaccacctctggacgagctgcccctgttccgggaatcgatcgactgttgggacctacgctggttacattgccccgacgcatacatatccagaacaccctggatatcaaacttttcctacggcaactacagcagcgctttacggagcagtccaagtatgaacacattggactgcagcagattcgccagctagggccatcggcggccagcgcgtgtcgcttccagactctcctagtcattcagcccgaccagccaaagcgccagctggcttgggctggaaaccaccagagtgcggccgaattgacgcagtttagcaatgttgcgttaaccctgatctgccagctcccctctccctcctcgacgtccattggcctgacagcagtttacgaccctcgagtactggcacccgcacagatgcagcgggttctgtcgcaagttggccatgtcttcagagagttacaggatgctccagacggtgttcccatcgcctcgctcaatatgctgaaccccagtgactccgcagaactgcaacagtggaataagctcactgttcctactggaaagcatcaagatcaagaatttgtgcatgacatgatacggcggcaatgccagcttcaaccagacgccgtagccgttgaggcatgggacggaagcctcacttatgaagagctggattcctacacggagtacctggctgcgaaactgcagctatgtggtgttcgcaacgaccacttcattgctctctacttcgagaagtcatgttggaccattgtcgcccaactggcggtcctgaaagccggaggggccctagtgatgctagagccttctcatcccgttgatcgccgtcgggagatttgccagactttggatgtcatgttaatccttggtcctcctcacctcactcattcgttggaacaggagctcaatatcaaggtactacctatcagcaaggctcatctcaaagcgtcggatggggaacatctatcagtcgacagtcatatacagtctcataacctcatgtatgccatcgctacatccgggactactggttgtcctaagctcgcattggttcatcatggcggttttgttgccactgcaaggaccttggttgataggctcctcttactggcatcgtctcgggtgcttcaattctctagttacggattcgacgcaagcttagtggaacaactgcttccgttaattgtaggaggctgcgtctgtgttcccaccccctttgaccgtgataaccgcctagcgttcacgatggcgaccatgaagatcaattggatggttgcaccagcatcagtgattcacctactttcacctgatacggtcccaacactacagacattaatatctgcgggtgagccattgcagcaaagtataatcgatgtgtgggccactcgagtcaacctcataaatgcatacggcccagcagagtgcagtatggtgtgctcggtcaacccaagcgtaaggccgggaaccgatccgaacaatatcggatacccaattggtggcacctgttggatagtagacccaaatgatatcaacacccttttgccaattggtgctgaaggagaactcctggtggaagggccgaacgtcggtgtcggatatgcgaaagaccctcggcgcacaagagttgcattttcatcatcaccgcctcactggctccgctccattcacggagaatcagtccacactcgaatataccgcacaggagatatcgctcgatataatcccgacggatctgtgctttacgtgggccgtaaggattcacaaatcaaattacatgggcagcggatcgagctcgccgaggtggaacatcatgtcaggctatgtttcccaggcgccatccaggtagttgttgagatggtcaagtttgacgattttgaaactagctccctcgttgccctcatcgtcgtgtctggctcaggctttccagcgtctggatcaaacatcctgctcccaacaaccacaaatttcctcaacaatgttcaacacgcggaagcactcctgcaggatcgtatcccaccctatatgatcccgacgctgttcgtaccggtggcacagattcccttcaataccaatggcaaggcagatcgtgctcgtctgagaacctcggttgcttctctgtccatccatgatcgtataggctatcgctccacggccacaacaaagcctaacacagatctagaaattgtgcttcatggaatctggtcccgtgttttgcggatctcacctcagaagcttggcatccatgaaagcttctttcgggtaggcggcaattctattagcagtatgcaactagcggcgcagtgcaacgaggctggccttccaatatccatccaggatatcttccgttgccgaacaatttcgcggttggcgtcatcattcaagggtcatcctgtccaggcggacagatctttagaagcacatagccaggatggatcactgggcccagtgcagcggctgctgcctgaagtagggcaccccaaggctccagtggattctactcttgccgccttcactgatggccagttcgaggagataaataacggcatcccggctggatatgaagggcagatacaagatatctacccctgctcccatgcacagcagggcatgctcatcagcaacacacgcaactccagcctctatcagcaagtctatcgctttgaagtggttagaggttatgatgcgcccaacgttgactgtcagcagttggtaagggcgtggcatgcggtagtcaagcgacatggagccctgcggaccgttttccttgatataccagggagagggttccaccagatcgtgctcgtcaatgcaatagacaatgtcataattgcggctgacggcaaccatagcagtacatgtacccaaaagagacctggtacacaagacctgtatggtcctttaccaactctaattattcaccaggagtatgatgagcggctttggatcgaactgcatataagtcatgctcttctagatggagtgtcactgcgaatcatcgaacaagacctcgtgaaagcatactacaacaacctaccctcttcattacctgactatcgggattacgtcacctatctgcgggcaaaaggagatacggaaatgtcattgagctactggaaaaaatacctggagggtgcgcagccctgcctctttccacgcctccgtgactctacagcagcagtgacagacgtgtcggagccaaaggcgacagtcgacttcgtgtcgcttgacttgggccctccgaagtctcttgatcagttgtgtgagactcattgcctgagccttaccgctatcttgcatgtagtttgggccattgtgctgcagcaatataccggaacggacagcgtgtgctttggatatgccacatccgcgcggcatgtccccatccctcatgtggatgaaatagttggtccaatgatcaacacgctgcccagtcaaatccaactctctagggattcatcagtactgtccactttacaaaagtacaccgttcacttcatgtcctgcatggagcatgcctacgtctcacttggacagatattacactcggctatgtccagtacacaatcacccttcaacacaatgataactattgttgagactggagatcgtagagacgacgctgatggatcctgcttatcgttggtttgtatggatggacatggggagacagagtatgcgttggccttgactgtttccaaagcatcgagccgcatggatttgcacctttcataccaaacatccatggtcaatgcttctcaggcccatgatgtgtgcctgatgtttcaaaaagtcctgtgtgaggtcttggagtggcccacggccaagattggtgccattgatgccctgaatatgggtcagagacagcgcatggaatcgaggcagcctaccccaccggctgctgcaaatacattgatatacgaaaccatcaatcggcgatgtgcagagcaaccatcctcatcagccgtctgtgcctgggatggtgaatttacctacggggaaattgatcagctctcatcagtattggcgggagagatccttgcccatggagttaaaccggaggacccggttttggtatgccttgaaaagagccgctgggttccggtggttatgctggcagtctggaaagccggggcatgcttaattcttctggatgccacccatccaactacccgattgcatatgattgccaagcaatctgccgcatcactggcaattgcaaatagaagtacgcgctccaaagcaaacatcctgtgctcacgagtattgcaagtcgatgatgaccgcttgtggactcgacatgttaactcctcgcgggccgagatggttcatgttgacggacacagcgctgcatacattatattcacatctggctcgactggaacacccaaaggggctgtgattgaacatgcttccctttccattgcgtgggagaccctcattactcgactacagttaaacccgacatcgcgtgttctacagtttgcctcccattcctgggatgcggcaatcatcgatgttatggccgcattgatgtcaggaggctgtctctgtgtaccctcggaaaacgaacgtatggggcatttggccttagctgcgaatcgtatgcgagccaattggatgctactgaccccaactgtcgcccgtcagcttactcctagcgagtttctttacctcgaaacgctagtccttggcggcgaacgggtcaatacaacggacattgaagtctggcatgataaagtctgtctcctgagcgcatatggcccagcagagtgcacgcaaatcacgagcgtgacgaggccgttagatatgacctgtgatgcgcggaacatcggcgtcccaaatgccagcgctggatgggttgtacgtccggacgaccctgaacagctcgtccccgacggagccattggagagttacttattgagggacccattgtgggccagggctatttaaatgagcctcagcgtacctatcaagccttcattgaggcccccagttggttgcaggccattcgctcccccggtaccattcgggtctacagaactggggacctggttcggtttgcagctgacgggtcactcatctttgtcggacgcatggatgaccaggtgaagctacacggccagcggttagagctgggtgaggttgaacatcacgttcagcaggctttcgctgcatcgcttacggtgattgatctcatccaacccaaagaggagcaacaaatgggtccgttcctcgcagcatgtatcttctctcccggccatgcttgtaaatcaccatctcatgccggcatttgggagcccccttcagacacctttcgaaagaaagttcaagaggctagaacagcattgtatcagagcctgccttcatacatggtgccttctgtgtttctgccattggcatacctgcccaaatcaacgacaggaaaaattgatcgaaagcgtctccgcaattacatccttgacatgtcccaagaggaactcattacttatagctctcccgatgtcaactgggtggcctctgtcttaaccctcatggagacgcgcttgcaggatcatatttccagtatcctgcataaacaaccttggcaggtttcacccgatcaagatctctttcagctgggaatggattcagtgctagccatggccctaattgcaaggctgtacaaggacggcctcaagctaacggtcagggatatctttgagcaacctcagctgcgtaacctggctcttgtggtgcgagagacgttgcggccagatcaagaaggtgtcaggaaagcacacagccgcagcccccttctgcactatgcgaaggagattgctgatgagtggaagatggctttaacctccattgagcacattttgccaactacccgtttccagcgagagagcttggaggcgcgacacaaagtgtactttattttccattttcatggcaagatcgactgtcagcgtcttcagcatgctgtgcaggctgctgtagacaaatacgccatactgcgaacggtcttcattccttgggacgagtctacagttcaaataactttaggtgacgccactgtaccggtggaaatcacgacgaccgatctgaatccagtagaaatagcaggatccatttgccgcgaggattcatcagcacccgttgctcccggcaaactacacacccagcttcgcttgatcatggggtccaaccgtgattcaatggcccttcggttgtcccatgctcagtatgacggcatcagcatgcctcgcctgttcacggacatcgcccgggcatatcaggggataactttaagtcccgctaaggtggactttccggaatacctgcacagccgcatctataatattccttcgcaggcatacaagttctggcgcgacttgctccgaggttccagcatgacctatctacgttctgaatcttcatcagggtctccgccttcccataatcggggaagccttataacgagcaccacagaggtctcatacccgccagcccccgctggaaccacgatggccaccgtcgccaaggcagcttgggccctctgcctggcacacatggctggcactcacgacatcgtattcggtcagctcgtcaacggccgaaacctggagctgccagaggccgaaacggttgtgggtgcctgtgtcaattacgtcccagtccgtgtgactctccaggctgactggaccgtgtcaagcctcctccatgcggttcatcagcagcaaacccgcagcatggccttcgagacactcgaatatgacgagctggtggcgcagtgtacctcctggccggcagacacagacccgggtaccgggatccactacgtgaacatccccgatgcgtttgctggtagcggcctgcctggggtggggtcggactatgagacctatgtatcccgcttgccttattatcatccccgtgtgacctgtagtcccctctcgaagggaatacttgagcttacgctttccgtctcggatcagctgtgggatcagaatcaggcggatcagactctgcatctgtttgggcagactgtgactagacaaaatcttgttacttttactagttatgctatgcttgacactgctacaagattggctactgctcctagcaattatggtatctactacggctgtccactttctccgcactttcctctccgaaccattttgttttactcccaatgtcgtcaacacctagatacttcttaa

SEQ ID NO: 17 - RNA, 17202 nt, Aspergillus niger
augggaaguauaggagaccugcccguggggguauuucccacgcugguacccccgagcucuaguggucacacagaauuccaugccugggagauuuccccggacauccucacaaaucuucugcaaagcaguauccgaaaggaaguugaucugauagugcuguugcguagcaucugggccauuguucuccgccaauaugucgagucagacgggcugugcuucaaggcgggaagcaugacuucagcuugcucugaguuggauaugcuggucuaucgagcuggcaucucuucacaugacaccccagaagguaucuggagacagcagcaaauaacgaccgguaucagugcgggaggucggaacugggaggugaauacuggugucuuucuacucaagcugugcagugauaggcaauggagagccagagcaauguugcagcaagcuguggaugcuugcuugguuauggaagaaguggaugccaaugcuccucgucucuauuuccuggcgaaagcgacauuauuauccagacagcaggcucaguauguugcagauacugucgcucaugucgccucagagauccugcgcaagcccaaccagacacucagggauacggauuucuuuaguccccaacaugcaccaauccuacacaaguggaaccaccguaccuucuggccuggcgagggcgacacucccucuuccauccuggacgccauucgacgacauagucagcggagccccgacgcgcucgcuauugucgcuugggauggcaguauuuccuacggagaucucgaggcacgcagcacgugucuggcagaguaucugcgucgugucgguguuggcccgggugucauggugccccugcuucuaggccacagccaaugggucaucaucacccaauuggccguccucaaagccggagcagccuuuguaccccuggagccaucgcauccacaggagagauugcgauauauagugcgcugugugaaagccuucuugauuguggcguccgaggcgcauugcgcucgggcucaacagcugguugagcaagucaucccgauuaacgagaacaucaugaauacagugcguaccgcacuccugucgacggcguacauaacuccgacugcagacgcuccggcauauguccuuuucaccucgggcaguaccgggcagcccaaaggcugugugaucgaccaccgugcgauggcccaacucccccaugaugguguagcagcgucagugggaccugacucacgugugcugcaauuugcgaccuauagcuucaccauggccaucuaugagauauauugguguuugaguaauggcgggacacucuguauccccucagaccaugacagguugaacaaucuuccuaccgugaucgaggagaugcaagucaccugggccgugcugacuccgucaguacugcgacggcugagccacgauaaccccccaucuaguuugcagacgcuugcccuaggcggagagccguuggcugccggggauauggaggccugggugcgaaagcugcaaguguuuuucgguuaugcgucuagugaagggacggcacugaauugccugacggagcugagcgagcaaucacaugccuuagaguauacgccuaccccccggguucgucacuggaucguugaucccgacaaccaugauaaacucgcggcagugggcacaguuggggaguugaucguugagagucccggacucgcccgcgaauaccuggacaauccaaccgcuacugccgccgcauucauucaaagucccgacuggagaaggucauuucgauuuucccaggaugcgagccaaccgauccguauguauaaaaccggagaccucuuccgcuauacggaaaggggcaaccugcaguacguuggccggaaggccacgcaagucaagauccgcggccaacguuuggauuugggagaagucgaauacaacgucagccaacaguguccugcacccgcccgagugauugcagagacaggggucccgagagauggggcagggacaauguuacuagucgcguuucuuuauucggacaacuacacauuagagcaaucagaaacgacgcagucagaugaggccucucuauuugcuguccccuccgaucaguuccgcgccgacaugaagauuuuaacacaagcauuagaaccauuguuaccggcccauaugcuuccuggcaucuacauuccucugcgacgcuucccaucgacguugacgggcaaagccgaccgucgucuguuacgcgaacugauccagcagcacacucguggcgaguuggagcguuaccagucugugacgacuaauaauguagcgccuccaagcacucgccuggagcgagaccuucacggccuuuucgccgagguacuggggauaaaugcucaggacuucgggauuaaucacagcuucauacgucugggaggagauucucucgccgcgaugaagcuggucaauuugagccguaagcuaggccugcgcuugacagucgcgcagauuauggagagcaagacuguugccaagcugagcaacacaacguuggccgacgagucuucuguuagcacgauaaucccucugagggauggcccucucgaagccaaacuuccgcucgacuuuugggaagguaucgaagaagaacacaucgaauccauuuccaacugcuccaccauccagcagggcauucuauugggacacauucgaaacccagcccacuaccauaaucgaauagugugggaaguccuugagcccccugcagcacgagauaucgaucgaaugcgccgugcaugggcgcacguuugccgccgucaccccaugcuacguaccuuuuucguggaagcuccagccggaaacagcucccuggcgcuucaaaucacgcugaaagugucccgcuuccgcccugaggauguggauguguuguaugaggagccugaacaaaugcccagcacgaaucccacucuagccucugaacagccccuacaguggauuccccgauuacgaaucuaugaggcuaccggcaaucggcuauacugugcaaucgauauucaucauguucagguggacaugaucuccuuggggauaauuauccgagaucugaggcguugcuaucuggaugagacugaguauguugcagcgggcgacgugucugaacccaacagugugucauacaccgacuacacccaguaucucguugcaucccagucagcggagagucucaguuacuggagaauucgccuagcucauacggagccguguauauuuccccgccugcagcagggcccguuugaggccgcuucgucagcccuuugcaguguagagcucccucugacgccgauagcugaccaucugcagucauucugcaaggauacggaagucaccguggccacgguguucaagcuugccuggucacuggugcuaagcgcauauacugggucucgcugugccuguuaugguucggugacggcaaugagagaugucccuuuagcgggugucgaagaucuggucgggccacuaaucaacacgcugccguuuuguguggaauugaacccugacgaaagagugaugaaugugcuucgacggguccaaaaucuauuccucgaagaacuaccacaccgacaaguauccauugcagaacuucaacauucccuaaauaauagcagcgguacucucuucaacaccacaaugagcuuugucgacagcuuagacccugcagcagauucccaacacccuauacgauuggucuccugguacggaccgacugaauaugaccucguaguugaaguaacuccagggccccccgucucgugcugcaucagauacuggagccauaugauguccgacuggcaagcauccgcucucgcagauacucuagccaugucgguuucgcagauucuacguggugcaucuucaggccaguccgucggaagccucgaucuauguacggcccgagauaagcagaagcucguugaauggaaugggucucccccggaggccgugcgggugcgugugcacgauuugaucaaggcucgaugcaucgagcagccagaugccuuggcggugugggccugggauggugcuuugagcuaucgggagcucgacugucuuuccucgaaucuagcuagaaggcuuauggcccguggggucgggccugaagcguuugucgguauuuguuuugaccggugcaaauggacguugguaucgguucuagcugucgccaaagcugggggugcauuuugccugauggacucgucgcauccgacauaucgccugcgcgaaaucugugaugccuugggagcaaauuuagugaucacgacaccaaaacaugucgcaaagguauccaaaugcgaacgucccuuguugguaguaguggaggguguguguucugaaacagacgauuugccagguggauugggguccgaauaucgugacacacuuccucgaaaugcccuauaugcagucuucacauccggcucgacgggaaagcccaaaggcgucguuaucacacacgagaaucuggcugcaacaaucaaaaauugcccucaacgguuggaccuacgaccaggcgaucggucucuucauuuugcgucuuacgccuuugacuucaguaucaucgagguuauaguucccaugguagugggggccugcgucugcauuccaucggagcaugaccguuugaauaauuugcccaaggccauggcggaccuugcgguaaccugggcgauuaugaccccgacggugucucgguuacuagaaccugccagccuacccacccuucgaacuuuaguccuuggaggagaggcaaucaugccuuaugauuucacgaccuggcaggguuacacgacccucaucagcgcauauaguccggcugaaugcacgccgauuggacuuugcacugugguucaggcggaugauccgaacuguuugggcaagccauucacuucuaugucgcccuggaucguugacccagaaaauguucagcgguuggucccggucggugcuguaggagagcucgucauagaagggaccgucgucggucgaggcuaucuacacgaugcagagcaccgugauauagucuccucaccguucaucccuccgacucaguggcuaucccaauaucgaaccaucgacgugacuaacccuucgcgcuuauaucgcaccggggaccuuguccaauuuacugaggacggggcgguacgauuuaucgggcgcaaggacuugcaggucaagauccggggccagcgacuggaauugggcgaaguggaaucucgacuccgaagcuaccucccuugggcuggcgcaauugucgucgaagcuguugucuugaaaucccccgguggucgcgcaguacuggucgccuuuauauccauuaacuccccagauguuacagacaacgccgagacagugugcgagauagccggaucguuugauaaugaugacaauaguguauaucagcgugauaucgauaaggcucuuucacaucuuggggaugagcuaccgaacuggauggucccuucggugguucugaaggugcagggcaucccaaugaccaaauccggaaaaguugaucgacgcagacugcgacaacuagcuacccugauuccccgagagacgcuaggggccucuaauguccauaguucucuucgucaagcuccagucaccgaagaagagagacggcuacagauggcuuucgcgaacaucuugcaaaugcggccugaggagauauucgcugacagucacuuuuuccaacuugggggugauucuguuggagccauggagcugguggcagcggcgaggcuacagaauaugggaaucagugucagugagauuuuccagcauccuacauugagugagcuggcagcgguggcaaccaagaccauggaugaggagacuucugagauuccgcccuucagccuucuacccagugacuacgaaucggauaucaucucauccgcucuagagcaaugugcucuaucgcugaaugacuugggugauaucuauccguguaccgccuuucaggaaggguuaauggcccuugccagucaaaaagcuggcaaguacgucugucagugucuauuugagcucggacgugauguugagauaaauaaauugaagaccgcguggcaagcaacagugacugccaaugauauccuccgcacccggauuauucacguucacccgcacgguaccuuccaggugguccugacgccagccgcagcuccgauuuuguggcacagauaugagaccgucaaugaauggcgcaagaaggauauggaacugaacauggaacugggaaccacauuggcucgcuuuagcauccucagcucggcccagggacagacacucguaggugucucucuccaucaugccauuuacgauggcgucucccugccccgacucuuugaccaggugcaaagggcauaucagaaugaacgucuaccccucaauaaauucacacccuuuauucgcucucuaaucuugcagaauccuaaggauguugaagaauucuggcgcaccgaguuccauggucuucagacuucgguauucccagguuugcccgagccuggauuugugcccaacccuacagcgagcguggaaaaggagaucaggcucccacggccaccgcaccugccaaguguuacccuuucaacaguaaugaggcuggcaugggcacugcugguaucauauuauacagauucugaggauguggucuuuggcgucaccgucaguggucgagcgcggucuguuccugggauaaaccuucuaacuggcccuucuauggccacuguuccauuccgcacgcgaauuugucgugauagucuacuucuggacgcucugcgugaugcucaggaccauuccaugcgcaugauucccuuugagcaggcaggucugcaaaggauccgagagcucagcgaugaagcuagcguugccugcggauuucagucacaguuggucauucaacauggcgagcauagccaggccuccccuaacaugaugauacugcgugaucaguuugcggaucaugcggcguuucucaacuacgcacugguuauauugugcaccccaucaacggcacaucaaaccguacgcgugaacuuucaguucgauccgcaaauuguacugccggcggucgcagaucgacugcugagccaauuugcccauaucguggaucagaugugugcgccaucuagcuacaacgcuaggcucgggggccucgaaacaauaacuccccaagauuggaccucgcugcggcaauggaacggcagccuaccagccgcauacccucauccgcuucaucaucucguacugucgcaggcggagaccacacccgacaggcgggccguggagucaugggauggaaccuugacauaugcugaauugaaugaucucucgggaaagcuagggcagcaucuguugaaccguggacugaaacaggguucacgggugguucuccuuuuugaccgcucccucauaucgguugugacaauguuggcagugcuucggucaggaggcauaugugucaacauugacccaucucuaccgcagacucgcauuacccagacaauacaccaagcacggcccucaguggcauugguaucaucuacauaucagucgcggcuggcagaugcauugccgguuccuguccucacgauugcacuggauaccauaccacgaagcgcaaagaacaucccuuggccacuugugcgcucuacugaccuugcauuuauucucuucacuuccgguaccacgggaaagcccaaaggcaucaugguagaacauggaaauugcgcuaccgacauuuuucacuacagugcuaucuuggccgucaccccggaaauaagaacacuacauuucuguagcuaugcauuugacuugaguaucuacgagguucugacacccuggaugcacggcggaugucugugcaucccaucagagucugcacggcuuucagauuugcccggagucauccagaaauaccacgucaacuucgcaauccugacuccauccguggggagugcgcuacauccaagugaccuucccagccugcaaacccucauccuggguggugaagugaugccugcggugauguucgaccgcugggccucucauguacgcuugaucaacuuguauggcccagcagaggccacccagugugccgcucuccaccugaaacccacagacgaguuugugccaggacuuauuggugcuaugguuggcgccucgggcugggucacggucccuggcaguccaaauugccucacccccauuguugcggugggcgagcuccugauagaaggcccagcgguaacucggggcuauuuugacgaaauggaacagacgcaagcaucauauaucgauccgccagccugguugcaggaguuucgcgggccugcugagccuggccgccucuucugcucuggagaccuggugcaguauguaccuaaccggccagguuggcugcgcuacauuggacgcaaggauaagcaagucaaaauccgugcacaaagggucgaccugacggaagucgagcaccaugucgaugagcuacucccaccaggcagucaggcaauugccgagguccuguuccagcacucgucuccccgccaaucgagccagcuugcaguauucuuggccuuuggugaacaguuaaccaacaaaauggacaucauaugcgcccucgaugagccauucagaagauuaauagcugaaauccacccacagcuucagaaaaggcucccuucuuacaugguccccacccucuucuuuccgguaucucacguuccucaaacacccaccgguaagaccgaucgaaaucgguugcggcaguugguagaaggguggacgaccgaacagcugcugccauaucauccguucaguacagauucagcgcgugcgccaguagagacggcugaggagcgcaucuggcagcacauguggugcgagguacucugcauacgucccgagaauaucgccagaacuagucauuucuuucaccuuggcggugagucuguuagagcgaugagguuggccggguuggcacaacgugagggauggaucauuuccgugccagauauuuucgcucauccgacgcuaucggaaauggcgagucucgcuguacccucccccaagggugugccgguuccaucuccagaccguuucagccugguaggaagcggaaggcgggcaucauaucugguuaauauggcgacucaccagugcaacgucaccaaaagugagauagaggauauauauccuuguaccccgcuccaggagacucucauagccucaacgguacaaaaaggaggcuccuaccaagcgcuggaagccuuugaucugauagccgauguggauuuggaacgcuuggaaauggcguggcaaaagacagcggccgaucaugcuauccuccgcacgcgaauuaugcaagacuauaccggcgaacuguuucaggugguagucaaagguccguuagcauggaccgcggaacaagcggacauaaacccugagaauggguuacugcauuuccagcguaccaugggcauugggacacccuugauucaucuaguccuucuacaaucucccggauccacgauacccgaucgucucuugcucucgauacaucacgcauuguacgauggauggucccugccccuguugcucgaggaggucaaucagaaauacaucggcccauaucggggccaagacacaaccgugccuuucaacguauuugucucgcauguaauuaaauccauggacagguguugucauuuuuggaaacaggaguuggaaacgaagacagaagcucgacuauuuccacguuugccggacggggcauacgagccacacccacaggcuauuuugcaggaccaagucuuuguuagcccgacgcggaaugaaucugagauaacccucgcaaccaugguccaggcaucuugggcauugacagugaguugcuacuugaacgcaagcgauguaggguucgggaucaccaccucuggacgagcugccccuguuccgggaaucgaucgacuguugggaccuacgcugguuacauugccccgacgcauacauauccagaacacccuggauaucaaacuuuuccuacggcaacuacagcagcgcuuuacggagcaguccaaguaugaacacauuggacugcagcagauucgccagcuagggccaucggcggccagcgcgugucgcuuccagacucuccuagucauucagcccgaccagccaaagcgccagcuggcuugggcuggaaaccaccagagugcggccgaauugacgcaguuuagcaauguugcguuaacccugaucugccagcuccccucucccuccucgacguccauuggccugacagcaguuuacgacccucgaguacuggcacccgcacagaugcagcggguucugucgcaaguuggccaugucuucagagaguuacaggaugcuccagacgguguucccaucgccucgcucaauaugcugaaccccagugacuccgcagaacugcaacaguggaauaagcucacuguuccuacuggaaagcaucaagaucaagaauuugugcaugacaugauacggcggcaaugccagcuucaaccagacgccguagccguugaggcaugggacggaagccucacuuaugaagagcuggauuccuacacggaguaccuggcugcgaaacugcagcuaugugguguucgcaacgaccacuucauugcucucuacuucgagaagucauguuggaccauugucgcccaacuggcgguccugaaagccggaggggcccuagugaugcuagagccuucucaucccguugaucgccgucgggagauuugccagacuuuggaugucauguuaauccuugguccuccucaccucacucauucguuggaacaggagcucaauaucaagguacuaccuaucagcaaggcucaucucaaagcgucggauggggaacaucuaucagucgacagucauauacagucucauaaccucauguaugccaucgcuacauccgggacuacugguuguccuaagcucgcauugguucaucauggcgguuuuguugccacugcaaggaccuugguugauaggcuccucuuacuggcaucgucucgggugcuucaauucucuaguuacggauucgacgcaagcuuaguggaacaacugcuuccguuaauuguaggaggcugcgucuguguucccacccccuuugaccgugauaaccgccuagcguucacgauggcgaccaugaagaucaauuggaugguugcaccagcaucagugauucaccuacuuucaccugauacggucccaacacuacagacauuaauaucugcgggugagccauugcagcaaaguauaaucgaugugugggccacucgagucaaccucauaaaugcauacggcccagcagagugcaguauggugugcucggucaacccaagcguaaggccgggaaccgauccgaacaauaucggauacccaauugguggcaccuguuggauaguagacccaaaugauaucaacacccuuuugccaauuggugcugaaggagaacuccugguggaagggccgaacgucggugucggauaugcgaaagacccucggcgcacaagaguugcauuuucaucaucaccgccucacuggcuccgcuccauucacggagaaucaguccacacucgaauauaccgcacaggagauaucgcucgauauaaucccgacggaucugugcuuuacgugggccguaaggauucacaaaucaaauuacaugggcagcggaucgagcucgccgagguggaacaucaugucaggcuauguuucccaggcgccauccagguaguuguugagauggucaaguuugacgauuuugaaacuagcucccucguugcccucaucgucgugucuggcucaggcuuuccagcgucuggaucaaacauccugcucccaacaaccacaaauuuccucaacaauguucaacacgcggaagcacuccugcaggaucguaucccacccuauaugaucccgacgcuguucguaccgguggcacagauucccuucaauaccaauggcaaggcagaucgugcucgucugagaaccucgguugcuucucuguccauccaugaucguauaggcuaucgcuccacggccacaacaaagccuaacacagaucuagaaauugugcuucauggaaucuggucccguguuuugcggaucucaccucagaagcuuggcauccaugaaagcuucuuucggguaggcggcaauucuauuagcaguaugcaacuagcggcgcagugcaacgaggcuggccuuccaauauccauccaggauaucuuccguugccgaacaauuucgcgguuggcgucaucauucaagggucauccuguccaggcggacagaucuuuagaagcacauagccaggauggaucacugggcccagugcagcggcugcugccugaaguagggcaccccaaggcuccaguggauucuacucuugccgccuucacugauggccaguucgaggagauaaauaacggcaucccggcuggauaugaagggcagauacaagauaucuaccccugcucccaugcacagcagggcaugcucaucagcaacacacgcaacuccagccucuaucagcaagucuaucgcuuugaagugguuagagguuaugaugcgcccaacguugacugucagcaguugguaagggcguggcaugcgguagucaagcgacauggagcccugcggaccguuuuccuugauauaccagggagaggguuccaccagaucgugcucgucaaugcaauagacaaugucauaauugcggcugacggcaaccauagcaguacauguacccaaaagagaccugguacacaagaccuguaugguccuuuaccaacucuaauuauucaccaggaguaugaugagcggcuuuggaucgaacugcauauaagucaugcucuucuagauggagugucacugcgaaucaucgaacaagaccucgugaaagcauacuacaacaaccuacccucuucauuaccugacuaucgggauuacgucaccuaucugcgggcaaaaggagauacggaaaugucauugagcuacuggaaaaaauaccuggagggugcgcagcccugccucuuuccacgccuccgugacucuacagcagcagugacagacgugucggagccaaaggcgacagucgacuucgugucgcuugacuugggcccuccgaagucucuugaucaguugugugagacucauugccugagccuuaccgcuaucuugcauguaguuugggccauugugcugcagcaauauaccggaacggacagcgugugcuuuggauaugccacauccgcgcggcauguccccaucccucauguggaugaaauaguugguccaaugaucaacacgcugcccagucaaauccaacucucuagggauucaucaguacuguccacuuuacaaaaguacaccguucacuucauguccugcauggagcaugccuacgucucacuuggacagauauuacacucggcuauguccaguacacaaucacccuucaacacaaugauaacuauuguugagacuggagaucguagagacgacgcugauggauccugcuuaucguugguuuguauggauggacauggggagacagaguaugcguuggccuugacuguuuccaaagcaucgagccgcauggauuugcaccuuucauaccaaacauccauggucaaugcuucucaggcccaugaugugugccugauguuucaaaaaguccugugugaggucuuggaguggcccacggccaagauuggugccauugaugcccugaauaugggucagagacagcgcauggaaucgaggcagccuaccccaccggcugcugcaaauacauugauauacgaaaccaucaaucggcgaugugcagagcaaccauccucaucagccgucugugccugggauggugaauuuaccuacggggaaauugaucagcucucaucaguauuggcgggagagauccuugcccauggaguuaaaccggaggacccgguuuugguaugccuugaaaagagccgcuggguuccggugguuaugcuggcagucuggaaagccggggcaugcuuaauucuucuggaugccacccauccaacuacccgauugcauaugauugccaagcaaucugccgcaucacuggcaauugcaaauagaaguacgcgcuccaaagcaaacauccugugcucacgaguauugcaagucgaugaugaccgcuuguggacucgacauguuaacuccucgcgggccgagaugguucauguugacggacacagcgcugcauacauuauauucacaucuggcucgacuggaacacccaaaggggcugugauugaacaugcuucccuuuccauugcgugggagacccucauuacucgacuacaguuaaacccgacaucgcguguucuacaguuugccucccauuccugggaugcggcaaucaucgauguuauggccgcauugaugucaggaggcugucucuguguacccucggaaaacgaacguauggggcauuuggccuuagcugcgaaucguaugcgagccaauuggaugcuacugaccccaacugucgcccgucagcuuacuccuagcgaguuucuuuaccucgaaacgcuaguccuuggcggcgaacgggucaauacaacggacauugaagucuggcaugauaaagucugucuccugagcgcauauggcccagcagagugcacgcaaaucacgagcgugacgaggccguuagauaugaccugugaugcgcggaacaucggcgucccaaaugccagcgcuggauggguuguacguccggacgacccugaacagcucguccccgacggagccauuggagaguuacuuauugagggacccauugugggccagggcuauuuaaaugagccucagcguaccuaucaagccuucauugaggcccccaguugguugcaggccauucgcucccccgguaccauucgggucuacagaacuggggaccugguucgguuugcagcugacgggucacucaucuuugucggacgcauggaugaccaggugaagcuacacggccagcgguuagagcugggugagguugaacaucacguucagcaggcuuucgcugcaucgcuuacggugauugaucucauccaacccaaagaggagcaacaaauggguccguuccucgcagcauguaucuucucucccggccaugcuuguaaaucaccaucucaugccggcauuugggagcccccuucagacaccuuucgaaagaaaguucaagaggcuagaacagcauuguaucagagccugccuucauacauggugccuucuguguuucugccauuggcauaccugcccaaaucaacgacaggaaaaauugaucgaaagcgucuccgcaauuacauccuugacaugucccaagaggaacucauuacuuauagcucucccgaugucaacuggguggccucugucuuaacccucauggagacgcgcuugcaggaucauauuuccaguauccugcauaaacaaccuuggcagguuucacccgaucaagaucucuuucagcugggaauggauucagugcuagccauggcccuaauugcaaggcuguacaaggacggccucaagcuaacggucagggauaucuuugagcaaccucagcugcguaaccuggcucuuguggugcgagagacguugcggccagaucaagaaggugucaggaaagcacacagccgcagcccccuucugcacuaugcgaaggagauugcugaugaguggaagauggcuuuaaccuccauugagcacauuuugccaacuacccguuuccagcgagagagcuuggaggcgcgacacaaaguguacuuuauuuuccauuuucauggcaagaucgacugucagcgucuucagcaugcugugcaggcugcuguagacaaauacgccauacugcgaacggucuucauuccuugggacgagucuacaguucaaauaacuuuaggugacgccacuguaccgguggaaaucacgacgaccgaucugaauccaguagaaauagcaggauccauuugccgcgaggauucaucagcacccguugcucccggcaaacuacacacccagcuucgcuugaucaugggguccaaccgugauucaauggcccuucgguugucccaugcucaguaugacggcaucagcaugccucgccuguucacggacaucgcccgggcauaucaggggauaacuuuaagucccgcuaagguggacuuuccggaauaccugcacagccgcaucuauaauauuccuucgcaggcauacaaguucuggcgcgacuugcuccgagguuccagcaugaccuaucuacguucugaaucuucaucagggucuccgccuucccauaaucggggaagccuuauaacgagcaccacagaggucucauacccgccagcccccgcuggaaccacgauggccaccgucgccaaggcagcuugggcccucugccuggcacacauggcuggcacucacgacaucguauucggucagcucgucaacggccgaaaccuggagcugccagaggccgaaacgguugugggugccugugucaauuacgucccaguccgugugacucuccaggcugacuggaccgugucaagccuccuccaugcgguucaucagcagcaaacccgcagcauggccuucgagacacucgaauaugacgagcugguggcgcaguguaccuccuggccggcagacacagacccggguaccgggauccacuacgugaacauccccgaugcguuugcugguagcggccugccugggguggggucggacuaugagaccuauguaucccgcuugccuuauuaucauccccgugugaccuguaguccccucucgaagggaauacuugagcuuacgcuuuccgucucggaucagcugugggaucagaaucaggcggaucagacucugcaucuguuugggcagacugugacuagacaaaaucuuguuacuuuuacuaguuaugcuaugcuugacacugcuacaagauuggcuacugcuccuagcaauuaugguaucuacuacggcuguccacuuucuccgcacuuuccucuccgaaccauuuuguuuuacucccaaugucgucaacaccuagauacuucuuaa

SEQ ID NO: 18 - protein, 5733 aa, Aspergillus niger
MGSIGDLPVGVFPTLVPPSSSGHTEFHAWEISPDILTNLLQSSIRKEVDLIVLLRSIWAIVLRQYVESDGLCFKAGSMTSACSELDMLVYRAGISSHDTPEGIWRQQQITTGISAGGRNWEVNTGVFLLKLCSDRQWRARAMLQQAVDACLVMEEVDANAPRLYFLAKATLLSRQQAQYVADTVAHVASEILRKPNQTLRDTDFFSPQHAPILHKWNHRTFWPGEGDTPSSILDAIRRHSQRSPDALAIVAWDGSISYGDLEARSTCLAEYLRRVGVGPGVMVPLLLGHSQWVIITQLAVLKAGAAFVPLEPSHPQERLRYIVRCVKAFLIVASEAHCARAQQLVEQVIPINENIMNTVRTALLSTAYITPTADAPAYVLFTSGSTGQPKGCVIDHRAMAQLPHDGVAASVGPDSRVLQFATYSFTMAIYEIYWCLSNGGTLCIPSDHDRLNNLPTVIEEMQVTWAVLTPSVLRRLSHDNPPSSLQTLALGGEPLAAGDMEAWVRKLQVFFGYASSEGTALNCLTELSEQSHALEYTPTPRVRHWIVDPDNHDKLAAVGTVGELIVESPGLAREYLDNPTATAAAFIQSPDWRRSFRFSQDASQPIRMYKTGDLFRYTERGNLQYVGRKATQVKIRGQRLDLGEVEYNVSQQCPAPARVIAETGVPRDGAGTMLLVAFLYSDNYTLEQSETTQSDEASLFAVPSDQFRADMKILTQALEPLLPAHMLPGIYIPLRRFPSTLTGKADRRLLRELIQQHTRGELERYQSVTTNNVAPPSTRLERDLHGLFAEVLGINAQDFGINHSFIRLGGDSLAAMKLVNLSRKLGLRLTVAQIMESKTVAKLSNTTLADESSVSTIIPLRDGPLEAKLPLDFWEGIEEEHIESISNCSTIQQGILLGHIRNPAHYHNRIVWEVLEPPAARDIDRMRRAWAHVCRRHPMLRTFFVEAPAGNSSLALQITLKVSRFRPEDVDVLYEEPEQMPSTNPTLASEQPLQWIPRLRIYEATGNRLYCAIDIHHVQVDMISLGIIIRDLRRCYLDETEYVAAGDVSEPNSVSYTDYTQYLVASQSAESLSYWRIRLAHTEPCIFPRLQQGPFEAASSALCSVELPLTPIADHLQSFCKDTEVTVATVFKLAWSLVLSAYTGSRCACYGSVTAMRDVPLAGVEDLVGPLINTLPFCVELNPDERVMNVLRRVQNLFLEELPHRQVSIAELQHSLNNSSGTLFNTTMSFVDSLDPAADSQHPIRLVSWYGPTEYDLVVEVTPGPPVSCCIRYWSHMMSDWQASALADTLAMSVSQILRGASSGQSVGSLDLCTARDKQKLVEWNGSPPEAVRVRVHDLIKARCIEQPDALAVWAWDGALSYRELDCLSSNLARRLMARGVGPEAFVGICFDRCKWTLVSVLAVAKAGGAFCLMDSSHPTYRLREICDALGANLVITTPKHVAKVSKCERPLLVVVEGVCSETDDLPGGLGSEYRDTLPRNALYAVFTSGSTGKPKGVVITHENLAATIKNCPQRLDLRPGDRSLHFASYAFDFSIIEVIVPMVVGACVCIPSEHDRLNNLPKAMADLAVTWAIMTPTVSRLLEPASLPTLRTLVLGGEAIMPYDFTTWQGYTTLISAYSPAECTPIGLCTVVQADDPNCLGKPFTSMSPWIVDPENVQRLVPVGAVGELVIEGTVVGRGYLHDAEHRDIVSSPFIPPTQWLSQYRTIDVTNPSRLYRTGDLVQFTEDGAVRFIGRKDLQVKIRGQRLELGEVESRLRSYLPWAGAIVVEAVVLKSPGGRAVLVAFISINSPDVTDNAETVCEIAGSFDNDDNSVYQRDIDKALSHLGDELPNWMVPSVVLKVQGIPMTKSGKVDRRRLRQLATLIPRETLGASNVHSSLRQAPVTEEERRLQMAFANILQMRPEEIFADSHFFQLGGDSVGAMELVAAARLQNMGISVSEIFQHPTLSELAAVATKTMDEETSEIPPFSLLPSDYESDIISSALEQCALSLNDLGDIYPCTAFQEGLMALASQKAGKYVCQCLFELGRDVEINKLKTAWQATVTANDILRTRIIHVHPHGTFQVVLTPAAAPILWHRYETVNEWRKKDMELNMELGTTLARFSILSSAQGQTLVGVSLHHAIYDGVSLPRLFDQVQRAYQNERLPLNKFTPFIRSLILQNPKDVEEFWRTEFHGLQTSVFPGLPEPGFVPNPTASVEKEIRLPRPPHLPSVTLSTVMRLAWALLVSYYTDSEDVVFGVTVSGRARSVPGINLLTGPSMATVPFRTRICRDSLLLDALRDAQDHSMRMIPFEQAGLQRIRELSDEASVACGFQSQLVIQHGEHSQASPNMMILRDQFADHAAFLNYALVILCTPSTAHQTVRVNFQFDPQIVLPAVADRLLSQFAHIVDQMCAPSSYNARLGGLETITPQDWTSLRQWNGSLPAAYPHPLHHLVLSQAETTPDRRAVESWDGTLTYAELNDLSGKLGQHLLNRGLKQGSRVVLLFDRSLISVVTMLAVLRSGGICVNIDPSLPQTRITQTIHQARPSVALVSSTYQSRLADALPVPVLTIALDTIPRSAKNIPWPLVRSTDLAFILFTSGTTGKPKGIMVEHGNCATDIFHYSAILAVTPEIRTLHFCSYAFDLSIYEVLTPWMHGGCLCIPSESARLSDLPGVIQKYHVNFAILTPSVGSALHPSDLPSLQTLILGGEVMPAVMFDRWASHVRLINLYGPAEATQCAALHLKPTDEFVPGLIGAMVGASGWVTVPGSPNCLTPIVAVGELLIEGPAVTRGYFDEMEQTQASYIDPPAWLQEFRGPAEPGRLFCSGDLVQYVPNRPGWLRYIGRKDKQVKIRAQRVDLTEVEHHVDELLPPGSQAIAEVLFQHSSPRQSSQLAVFLAFGEQLTNKMDIICALDEPFRRLIAEIHPQLQKRLPSYMVPTLFFPVSHVPQTPTGKTDRNRLRQLVEGWTTEQLLPYHPFSTDSARAPVETAEERIWQHMWCEVLCIRPENIARTSHFFHLGGESVRAMRLAGLAQREGWIISVPDIFAHPTLSEMASLAVPSPKGVPVPSPDRFSLVGSGRRASYLVNMATHQCNVTKSEIEDIYPCTPLQETLIASTVQKGGSYQALEAFDLIADVDLERLEMAWQKTAADHAILRTRIMQDYTGELFQVVVKGPLAWTAEQADINPENGLLHFQRTMGIGTPLIHLVLLQSPGSTIPDRLLLSIHHALYDGWSLPLLLEEVNQKYIGPYRGQDTTVPFNVFVSHVIKSMDRCCHFWKQELETKTEARLFPRLPDGAYEPHPQAILQDQVFVSPTRNESEITLATMVQASWALTVSCYLNASDVGFGITTSGRAAPVPGIDRLLGPTLVTLPRRIHIQNTLDIKLFLRQLQQRFTEQSKYEHIGLQQIRQLGPSAASACRFQTLLVIQPDQPKRQLAWAGNHQSAAELTQFSNVALTLICQLPSPSSTSIGLTAVYDPRVLAPAQMQRVLSQVGHVFRELQDAPDGVPIASLNMLNPSDSAELQQWNKLTVPTGKHQDQEFVHDMIRRQCQLQPDAVAVEAWDGSLTYEELDSYTEYLAAKLQLCGVRNDHFIALYFEKSCWTIVAQLAVLKAGGALVMLEPSHPVDRRREICQTLDVMLILGPPHLTHSLEQELNIKVLPISKAHLKASDGEHLSVDSHIQSHNLMYAIATSGTTGCPKLALVHHGGFVATARTLVDRLLLLASSRVLQFSSYGFDASLVEQLLPLIVGGCVCVPTPFDRDNRLAFTMATMKINWMVAPASVIHLLSPDTVPTLQTLISAGEPLQQSIIDVWATRVNLINAYGPAECSMVCSVNPSVRPGTDPNNIGYPIGGTCWIVDPNDINTLLPIGAEGELLVEGPNVGVGYAKDPRRTRVAFSSSPPHWLRSIHGESVHTRIYRTGDIARYNPDGSVLYVGRKDSQIKLHGQRIELAEVEHHVRLCFPGAIQVVVEMVKFDDFETSSLVALIVVSGSGFPASGSNILLPTTTNFLNNVQHAEALLQDRIPPYMIPTLFVPVAQIPFNTNGKADRARLRTSVASLSIHDRIGYRSTATTKPNTDLEIVLHGIWSRVLRISPQKLGIHESFFRVGGNSISSMQLAAQCNEAGLPISIQDIFRCRTISRLASSFKGHPVQADRSLEAHSQDGSLGPVQRLLPEVGHPKAPVDSTLAAFTDGQFEEINNGIPAGYEGQIQDIYPCSHAQQGMLISNTRNSSLYQQVYRFEVVRGYDAPNVDCQQLVRAWHAVVKRHGALRTVFLDIPGRGFHQIVLVNAIDNVIIAADGNHSSTCTQKRPGTQDLYGPLPTLIIHQEYDERLWIELHISHALLDGVSLRIIEQDLVKAYYNNLPSSLPDYRDYVTYLRAKGDTEMSLSYWKKYLEGAQPCLFPRLRDSTAAVTDVSEPKATVDFVSLDLGPPKSLDQLCETHCLSLTAILHVVWAIVLQQYTGTDSVCFGYATSARHVPIPHVDEIVGPMINTLPSQIQLSRDSSVLSTLQKYTVHFMSCMEHAYVSLGQILHSAMSSTQSPFNTMITIVETGDRRDDADGSCLSLVCMDGHGETEYALALTVSKASSRMDLHLSYQTSMVNASQAHDVCLMFQKVLCEVLEWPTAKIGAIDALNMGQRQRMESRQPTPPAAANTLIYETINRRCAEQPSSSAVCAWDGEFTYGEIDQLSSVLAGEILAHGVKPEDPVLVCLEKSRWVPVVMLAVWKAGACLILLDATHPTTRLHMIAKQSAASLAIANRSTRSKANILCSRVLQVDDDRLWTRHVNSSRAEMVHVDGHSAAYIIFTSGSTGTPKGAVIEHASLSIAWETLITRLQLNPTSRVLQFASHSWDAAIIDVMAALMSGGCLCVPSENERMGHLALAANRMRANWMLLTPTVARQLTPSEFLYLETLVLGGERVNTTDIEVWHDKVCLLSAYGPAECTQITSVTRPLDMTCDARNIGVPNASAGWVVRPDDPEQLVPDGAIGELLIEGPIVGQGYLNEPQRTYQAFIEAPSWLQAIRSPGTIRVYRTGDLVRFAADGSLIFVGRMDDQVKLHGQRLELGEVEHHVQQAFAASLTVIDLIQPKEEQQMGPFLAACIFSPGHACKSPSHAGIWEPPSDTFRKKVQEARTALYQSLPSYMVPSVFLPLAYLPKSTTGKIDRKRLRNYILDMSQEELITYSSPDVNWVASVLTLMETRLQDHISSILHKQPWQVSPDQDLFQLGMDSVLAMALIARLYKDGLKLTVRDIFEQPQLRNLALVVRETLRPDQEGVRKAHSRSPLLHYAKEIADEWKMALTSIEHILPTTRFQRESLEARHKVYFIFHFHGKIDCQRLQHAVQAAVDKYAILRTVFIPWDESTVQITLGDATVPVEITTTDLNPVEIAGSICREDSSAPVAPGKLHTQLRLIMGSNRDSMALRLSHAQYDGISMPRLFTDIARAYQGITLSPAKVDFPEYLHSRIYNIPSQAYKFWRDLLRGSSMTYLRSESSSGSPPSHNRGSLITSTTEVSYPPAPAGTTMATVAKAAWALCLAHMAGTHDIVFGQLVNGRNLELPEAETVVGACVNYVPVRVTLQADWTVSSLLHAVHQQQTRSMAFETLEYDELVAQCTSWPADTDPGTGIHYVNIPDAFAGSGLPGVGSDYETYVSRLPYYHPRVTCSPLSKGILELTLSVSDQLWDQNQADQTLHLFGQTVTRQNLVTFTSYAMLDTATRLATAPSNYGIYYGCPLSPHFPLRTILFYSQCRQHLDTS

SEQ ID NO: 19 - DNA, 22151 bp, Aspergillus niger
  misc_feature (20152)..(20251): n is a, c, g, or t
accaaagaactctcctttctcaattttctgtctggttcacttgtgggtgtcgaaagattcgtcatcctgcattagaagctagatttctcgacgtcggagtgatccgtcggatttgaatttggcatacgaagaagtcactttatgttaatagcttactcatgcgcttcagataattaactagtatcgtagttatttccttaccttgtatgtatttaatatactgatgtttattggtagggtggcactagctctgctccgacggccagggctgaccgtctttactacctaatagaggaaacggtaaactccgctgttaataactttaatacattattgccgccatgacacccgctctatctgggtgtacctgacccaaaacatccaatacactttgcggagtacatgtaaaacagtaaatagtcaatatacaaaatgagggcattatgtaattagtagcataagtcgacttggcttttcaggtcagatcgcgtgtaagggaaataccgaaaaagggtacttgtcatgtgagcccctcttcgctttttctgttctatttctttttgtctaattttttattcccccccgagtccggatgattatttatctatttaattatttttcccctaccactcgaacaaggaatactagcccctggttgtggggggaacgtatacgagtttcagttggacatgagatccatactcataacaaggcatattatcgactagagctggctttagggtatggagccgtacaagccccaattggatccgagcattggcttcccgatcaggaactggacttttgtatggacccagtcagtagcaaccacagcgagttcactgtccactctccgtgtccactccgcgccctcccccccccccccccagtagcacctggatctcttttccctactcgcctgcagtgtctgagtttcggggtttcctactcgctccttaccgttccgacagttctccgacagccttccgaatatacttagcgttatagccgctacgtgcaattacccaggtaggtataccacctggtgacttggcccaacgtcgagactaagacagctgagccttttcacttcgccgactttattcctgcaagacttcccactggtcagcatgcagtctgtcagtcctgtaccgtagattccagcatgtagtggagctggatgctaatgcagcgcctttctgacagacagagctcctaatcgaatgttgttaagcgttcgagaccgacctcgaagttccgggatgattgagagccgacataatgcacccaaagctggatacgccctctttatgcgccccgattttgagcaccaaccaacgtcatgccttggcttgtattgtattgttaagcgtgtcaaggccggtttccttgatttggattcggcctgcccagggtcaaactaatattttttttttctcattttctttttgtcttctttggtcctttgccccattgcctttcctgctgtctacccgcccctggttatacactacaaagtgggcaacccgagtttgatggtttcaagccatcggcttttgggttcaagcgccctgcagaactttgtaagccatggaatctcttccctgttgcctcttcagcttcgcctaagcaagggcatatggagtatactgtattagcgtggtggccaaaatccacgccattcattgcactacttcccgacccagtcattggccgccgtcattttcgtatttcgatgctcgtaagcaattgcaaatgctgctgagggaattccgcgcctaggtctctctatggatctattttgggccgagagaatttttggggggaccccatgataatggtggctccatggggacaggcttgatttcgttttaaaagtagcatattgtacgggggttggagatttctaggataacccatccactccctcccccttctcctctaggtgttccatcccaaatcctcagagagagatactttccggtacccccatctacattatggcccaacctgtctcttgttgcttgcccaagtttggcacgagcactcatgggccaaggcggcctgcttcgttgaggatcaggacgagtccttcccagactctccagttgctagccgcttgggaccaatccgagttagattctttactcaaggccacttgggccttgcttcttcatcgctatactggcctagaggacatttgctttggttaccaaccgattggagttgatgccggtccccgcgatactgttacttcttccgatacccataataatattcccttaacttttaatctgaccattaccgaggacgactctgtccatgccattttgcgcaacacaaaaaagcagaacgaagctgaaaaatgcggaagttcaagctcgagttgccacagttataccctgtgcaatacccttctaatgctgcgcaactgtcgcagtgttacgaaagatcccagagcccctcttgtgcaaccggccttggcaattcccttgcccgaaaaggtgggtgactttcctcgttctttggcgtcctctcactttctcttcgctccatctccccttcccccctcccaccttcgatcgtgtgcgcttctatcagcccaccgctgcaggtggccttggccttttaacccggactggctgacctctctgtagtgccgcgtcaggctgcacgtcaaagtcctgcagaaggatgtcggtatcttcttcgaatggtggaacaatgatatgtccactgagcatatgaagagcgtcgccgactacttcgagcagatactttcacgcgtactctcggcagaagatactgccgcgagggacctgaaccatttctcagatcgagattggtccagagtctgcaatttcaactctaccatcccccaggcacatgaccgctgtatacacgaggtcattcatgagcaagtcctggctcgccccggaagtgaagcagtttgtgcgtgggatggaagtttgacctaccaagatctggatctcctgtcatcccaagttgcttatcaccttcaagcacacggagtcggccctgaaaaatgtgtcgctctgtgtttcaacaaatcagtaagtttaacatcaaagatcgatatgtcctttggggcaggttgtgtcatcaagtgactcggcattttcgctattcgggactgactgattctcatagaaatggaatgtagtggcaatgctgggtgttctgaaagctggcggtgctttcgtcccccttgatccaacacatccaacctctcgtctacagtcgctggtgcacgctgtgcaagccaaggtcatgctttgctccagagaccgaataggagaattgactggggtagcggagatgataataccactggaccaggctatcatagacgaaatctcccttcaagctgaagaaatctactcattgccggatgtacaaggtcacaatgcagcctacgtgatattcacttctggatcaacaggagaacctaaggtgcgctattcctcgaagcttcccccagatccacattaacagcccgcgtttagggtaccatgctagagcacagagcctatgtatccggagccgctgcccatgctggaccgcaccatatgttttcgacttcacgcgtcttgcagtttgcggcacacacgtttgatgccagtcttgtcgagatcttgactaccttgttgcaaggcggctgtgtctgcattccaagtgaagaagaacgcttgagtgacatagtcaaggtcatcaacgagatgaacataaaccatgctattttgaccccatcctttgttgagttcattgattcctcgcaagtcccaggtcttgagaccttgattcttgctggagaggcgatgtcacaaggccagctggaaacatggtcgtccgccctccacctcatcaacgcctatggccccacagaaagctctgttgctgccgttgttaacgccaaagttacaccatcttctgattgtcgggatattggactccccgtgggcgtacgttgctgggttgtagacccgagcaatcatgaccaattagtacccgtgggttgtccgggtgaattactgcttgagggaccgacgctcgctcgatgctatctcaacaatcctcagaagacaagtgaagcgttcatccatgatccagcctggatgagaagggacggattaaatgactgtaaccggagagtgtacaagacgggtgatctggtaagatacaactccgactgtggctcactgacgtatataggcagaaaagacacgcaggtgaagtttcatggacagagacttgagttgggcgagatagaaaaccagctggctgccgacccaattgtcaaacactgtctagcttttctttcgaagtcagggttctctgcaggcaaattggtggcggtaatatccttatctgttcacttcgaatctcaaccggaatcaaatgcagcgccactcaagctccttgatacatcgaagaagacctctatcgttgcagaagttcgcgagagattatcagctaaactaccaacctacatgataccctccgtttggctgtgtgtggaggcattgccgttgcttccgtctgggaagctggacagaaaggcgaccgcaagatggattggagatatggagcgagacccgtatgcccaagctataagcgccaggactttgtctgcggataaagccacacttccttcgagtgccacggaggacaaactcgctgcgatctggagccgggttctcaatatcccccgaagccaacttgcccttgacgaaggctttttgagtctaggtggagactctattgccgccataacgtgcctcgggtattgcaagaagcaaggaatgggcttgacggtacaagaggtgcttcatagcaagtcaatcaaggagctggctactcgggtaaaacagatcgatcaatttgttgtgtacgaagaaaagatcgatgagccctttgacctttcaccaatccagaagcttcacttcatggtccgaaacgagggccaaggccacttcaaccaaagcattcttacacgcctgaaccggcacattgatgagcatagcatgcgacgtgcaattgagaccattatcaatcgtcactctatgctccgctctcgcctggtcgaatcagacgttgaggggataatgcggcaaagaataactcaagacgtagcagggtcttaccgttggcgttctcacaacaacagcaaccgaagcgaggtcgaccatgctatctcgaacagccagtcatgcatcaatgccttcgttggccccgtacttgcaatagatgtcttctatggaaatgaccattcccgcctgctgtcactcgtggctcatcatatggtagtcgacattgtttcgtggaggattattttggaagacttggaagacctactgatgaaccccgatcaaccgatatcacagaacggctcccttccgtttcagaactggtgccaaattcaagcagatcgttgtcaagaagcgacagctgaacgaaccatggatctgcctgaagttcccgcacccgattttgcctactggggactaaaaagccaccaaaccacctatggcgatgtggattgtgaaacgttcgatcttgacagtgatattactcgccacatactgactgggtgccacgaaagtcttcaaacagagccaatcgatctttttctagcagctttgctacactccttcggcgaaacgttcaaagaccgatcattgccagttatatacaatgagggacatgggcgagaagtctgggactcatcaatagatatctctcgcactatcggctggtttaccacactgtatcccattcttctatcggaacttcctgcaaaagatccaaccgaaacggttgtacgtgttaaggatttgcgacgttgtgttccggacaatggtcgacatgatttcgctcgtcgtatgttggttccacgcgaagatgggacttgtcggcactatagccccatggagatgtctttcaactatgtgggccagcaccgtgacctacagagaaaggatgggctcttccaactcatggatcagatggctggagaaacaggccgcggaggtgcagcggctgattttggtgaagaaactcctcgctttgcactgttcgagatatctgcgatggttgtgcagggtcaacttcgctttatcttctccttcaataggaatatgcagcatcagaatggtatccgtaactgggtacactgctgcaaaacattactggcatccctgggcgaacgcttacaggctctcccaccgaaaccaacgctaagcagtttccccatgttaacattgacatataccgaactcgatgcgttggtgtcgaaaaaattaccggatgccggtattcatagtcttgatgatgttgaggacatctatccttgctccagaatgcagcagggcattctactcagtcgctctcgcgatagctcactttatgctgtacatgacacattcgaaatatccgggccaggaagcacacccgacatcaaccgattgatacttgcctggcagaaagtcgttgctcaccatgcaatgctacggactatatttctggaggggttgagcagccacgacctacattgtcaagtggtgctcaaatcgttcgattcccgcccaacttacgtcgtatgtgcgaatgaaagcgaagtgctacctacatttgacaaacagcaaccgatgagctacgataatagtatacctcctcatcggcttacaatctgccaaacggcttctgggaagctgttttgtcgactggagctgaaccatgtcgccatggatggcgcatcaatctccatcatccttcgggatctgcaattagcgtaccaaggaaagctcgaagaaccaaagccgaagttcaaagagtatatacgctaccttcgtgaggttccccaagtcgcaagtcttgactattggcgcaattatttgttggatgtccaaccttgtcatttccccgtgctcaatgacggcaaaggctctgtaaggcagcttcggaccaagagattgggcggtgtgccattcaaagagctacgaaccatctgcgatatgaatggtctgacccttccgactgcctttagtgctgcatggggattaacggttcgctccttttgtggatcagatgacatctccttcacctatcttgcatcactaagagatgtcccagtagagggcgttgaatatgttgttggacctgtcatcaataccctgacctgtcgtatgctgtttgctaaagggacgtcactgaaggagatcctcgcaaaagttcaacaggataacctggacaatttgccgcacaggcatatctcactcacggagatccagcaagctttgggactaacagcctcattggctaatagtggtatttcttaccggaagcttcccaatcagaatgctttgtcaagcgaggagatacagttctctgaagtggggacaattcacgacccggcagagtcgcccgtttttgtcaatgttgaagctacagaagacgacgcacgtatcgaccttaactactggacagaccacctgtcggacgggcaagcagagaatgtcgcgagcacattccttaaatcggttgaaaatattgtgcaccactttgaggatgacgcccattcaattgacaactttagcgacgcgaacagacaaagcctaatgctttggaatagcgaagtcccaaagtccatcgacaaatgcatgcatgagatagttgatgagtgtgcgaaatcccaccctcacaccatggcaatttctgcttgggatggaaacctcacttatgctaagctcaatgaattgtcatcgctacttgcaacgtacttgacaacactaggggtgggccccggaacaatcgtgccccttgatctcgctagatcctcctggcaagttgtagccatcttggcagtcatgaagacaggtggtgtatgtgttccggtgaacccagcccgactgccacaacatttcgagacttggctcgtcgacaatgagatccaggttgccctagcatcaccgactcaaatgcaactactcgaaggggccgttccatatgtaatttccgtggagagctctctgtttgaatacctttcagacagtgatgcagtttcaagctcaccaattcagccatgcagcgatgcatatatcgtgttcggcgctgagagtcccaagtgcatcttgattgaccatcgtgcaataacaacccgggcaagcgcgttcgcttcaggtcttggactaaatgcacgaacaaagatgctccaatacgctccctatacttctgacatgttccttcaagaagtcttcggcacgttcctgtgcggtgggtctatctgcattccgtcagatgaagacctggcagacctgtcaaaagccatcaagacaatgcaggcgaactgtgtcagtatcacaccctcaatggcgatgactctaagattcgcagaggatctggggataaaggtccttgctttatggggtgaacacccgaccaagcaacttcttaccgccctgcctggaggaatccaagtgcatgcattctatggaacgccagaatgctcatcttcttgcattcgatcctctcagcttgacggatcatgcgaatcgtcaattattgggtcaagtcttggatgtaaatcttggcttgtagatccctccgatcacgatattttggttccgatcggctgcgttggcgaattgatgatagaaggcccaagtctttctcatggttactatcaagatgcggaactcacgcaacaatatttcgtcgaaaatcccttttggagactggcatacgaatcccagccatcatcagacaaagacaagaacacggacgcccagaagctgtcctatcgattgttcaagactggagatcttgctcgctacaactccgatggcacactcgtttacgttggtaagaaagatagaggattgcattggcagcgacagacagcggccatttacgtcgaagagcaaatcgcatctctctcatccttcaatgcccagtatgtcgttgaggagatcagcaagagaaatgtcgattctccccgatcgtctctggccatctttttctctgatgaggccgtcgactccaagggacaccaccagcctattgcacaattgtcacctgagctgcacgactcaatgatcaggctgtataaaaagctgtcgagctccttgccagcgaattctgtcccgagactgtattttccgacgtctagcataccactgaactcgttcggtaagctagaccgccagctgctgagaaatgcagctcaaaatctgccagaaggattgctgtctagattcgacatcaaaagctttgacagcttctggaaagggcagctggccacattggcggtttcgccagtgttcccgccaccccgtggctctttgtctcagccgagcacaccggtcaccaagcaagcaacaagaaacatgcagatggtctggtgtgatacactcagatcaatgaccgaaggtacacgatgtgctatcctttctgcatgggctcttactattcgcggctacaccagctcccgtgatattgtttttggggagttgctgtcagaagttgaattggcctccactgagcgtcaggacaattatacgcaagctgcaactatcgttccccgacgcttccaactcaacgatgattggaccgttactgagctactgagcagggtgaagaaccaactggagtcagctaagccctaccaatgggctggaataagtcaaattcagaaattgaacgctgatacggcgcgcgcctgtgatttcatgaacttgatctctataacggacaatcgtggccttgaaccaagtctagtacccatgaaacagcatgacagcaatctgtccggttatcctttgatggttgattgtatccttggagatgctacgctcgaactcttgattagttacgatgacagcactttaacaggcacccagatcgagcgactggctgcccaattcttcgcttgtgttggacttcttaactccaaggctagcatgagcaagacaattggtatcttgtccagagacaacatggacttttgctccttccgccatgatgttgcctactggaaaaactacttggaggatgttgaagcttgtcttttcccggcactacgtgcacgtgcggaggaaaatactcatgctgagactcagataatactccagaacaccaagcatctacatgatctcagtgaacgtgaacgtctcagcaaaagctcacttcttcagcttgtttggggcttggttctgcgatgctacacaggcctacaagatgtgtgcttcggatatcacatttcagatgcaagcgacagatctgccaagcctggagttgcgaataagccagatatttcaggtacattcccgtgcagaatgctcttgaatggtgaatctagggttgcggaaattttgagagagcgactgcaaggactgaatcaaatgcagcagcatcggttgccgtgggatgaagtccagcaagagcttgggtgtagcgacattttcaataccgttttcacttgttcagaacaatcaagtgacgcagtaaatgtggctggtctcgctgatcttgatccgagcaaatacctgattaccgtcaacgccactctagcagaatcatcaggagtcattaggttcggctatcaaaggaggcacttctcagaaaccgacatggaaggcgtccttgattgttttaataatattctgggacagttactccaatttcctcttccggatcttttggtaggcgaggttgactttgtgagtgagctttcctgccagaagatatctgagtggaactcggcgctgccagaccgtccagtgctatgcgcgcatgagctcatccaacagcaagccttggatcgtgctacggctcctgcaatttgttcttgggatggcaacttcacatatgcacaacttgaccgattgtcgactctcctagcaaaccagctggtgggcttaggggtcaagcccgacatctttgttgcattgtgtttcgaaaagtccgcatgggcagttgttgcacaggttgctgttttgaaagctggaggagccttcgcttcattagatccagctcacccagaaagccgcctacaaggcatgatcgatgatcttggcgctcaggttattctctgttctgagacacactacgagagagcctccagcatctgtcgtcgcgcaatgatcgtaagcaatagcgcacttgaacaactttaccactcaccctttgctgctccgacccaagaggtaaccgctgataacgcagcctacgccatattcacatcgggaaccacagggaaacccaaggtgacagtacttgagcatgttggacttaccctagcctgcacagagctctccagggccttcttcataagttcagaaacacgcgctctgcagttctcaagctatacattcgacgtcagcatattggaaactatcatagtccttgctgctggtggttgcatttgtatccctagcgaagatgagcgcatgaacaatctttctggagccatcagaaagatgaacgtcaacttcatgagctgtactccatctatcgttaataccatggaccccaatgctgttccttcattgcgaacaataactctcggaggagaaaaaatgactgcaagccatttcgagcgatgggctgacaggtgtgttattaacgcgtacggtccgtcagaggctactgtcgcctttacgtcaagcacaaaatacgaccatgcaggagtacgccttactgatgactatggttctattggcactgctatttgtggcaggacatggattgttgatccccaaaatcacaatcgacttgtgcccatcggcgcacccggagagctcgttcttgagagttgcactgttgctcgtgggtatctcaataatgacgggaaaaccaaggctgttttcatccgggacccggagtggactcagcgtgaagggctacagcatgtgttgaggcgcaaagaacggatgtatcgcacgggagatttagtgcgctacaactccgacggctcgattgctttcatttcgcgaattgatacacaagtgaaattgaacggtgtgcgcatcgaattggaagaagttgagcaacaatgcaacaactatctttcgacagatactcaggttgccgttgaggttgttactccagaggccaaaactatatcaaaatgcttggctgtcttcttcaccattgacgagcaccaaatgaaagatatggcgaatggtgaattcattctgcccatgtcagagtctgtagttcacatggtcaagaagctacacggttccctaagcgcttcattaccgctagctatggtgcccaagctttacttccccatgcggcgcctgccgtttggaagcactggcaaaactgatcgcaaagcacttcgagcaatggtcgatacatttaccaaggaacgcttgagaccatatgttatcttcaatgttggcacagaagaacgctccgatgtgggaacggaagggacagagggcgttctcaagacgctatgggaggaagtccttaaccttgcgccaggttctatcagtgccgaagacaacttcttcggcatgggtggcgactcgttttctgctatgaaactagtcgtagccgcggcatcccagaatatttcacttgcagtggccgacatataccgaactcctatattcaaagacatggcaaagacatgtggagcgggtgaggtacagactggcgtaccaacagtggaccctttcagcatgctgcctgaatctctttcacgcgatgatattctggaggaagtctctgatcaatgtggtgtgcctatggatcgaattgcggacatctacccttgtagtccggtgcaagagggcttgctcacactttctatcaaacaacccggagcctatgtcgctcgacctgtgttccaactcgcagagggagctgaccttgacaagtttaaagctgcatggcaaaaggtggttaatgaaatggatattcttcggactcgggtagtacacaccgagtccgccaactttgtccaggcagtgctcactgatgtccctatcctctgggaaacggcaacggaattggatgatttagcaaacgacactattgacctagccaagaataacgggggcttgctaactggatacgccattgtcgagtccggacactcgcgctccttcgtttggaccatacaccacgctctctatgatggatggagtgtgtcccagatccttcaacgagttgaggagatatactcgggtgcttcaaaacttagctcgacgcttccttacaagctctttatcaatcacctggtccagcaagaggctcattcctcggacgaattctggaagacacacctcgcggccctgtcttcatgtcctttcccccagaacaagccgtcacctgataccattcgcgtcggcaatcggcattacagctcgcttgagatttctcatgcaccaagtgggcctaatttaaccgttcctgaaatgatacgagctgcatgggcactaattgtatccgtccacaccggttccggagatgtctgcttcgctgaaaccctaatgggtagaaatattgatatgcctggggctatggaagttgcaggacctcttttgacaacggttcctatacggatggctgtcaacaacgagctctcgattattcagtacctcgataatgtgcgccagctgaccacaatgatgctgccgcatcaacattctgggctccagaggattcgcaagctaagcagcgacactgcccttgcttgcgaatcccaaaatctactggttattcaatcagaacaggcccattcgaacacaagtatctgggagcaaaaggataacctgactgaaggcgaatttttcacccacccaattgttgtcgaatgcaaggttggcgaatcgcaggtggccgtaacccttcatcacgacgagcttgttttcgacagttggcaggctaagatgctcattgaacagtttaccttcgttttgagtcaactgttatcaatctccaatgaagaatccagaaagatcggagagctagaggtttccagttctcgggataaggaagaaattgctctctggaatgagagaaacctgacttgcatagacagatgtgttcatcatatcattgaggagaaagcatccctccgacctcaagctcaagccgtctgctcctgggatggacaactaacttaccaggagctttaccagcttgcttcttcgtttgcagcttacctgaaaactcgtggcgtcggtccggagactttggttccgatctgtatggacaagtctttgtgggccattgtcacaatactgggtgtcctcattgcgggtggaggatatgtcccccttgaccctgctcacccaacgtcaaggcacaaggagattctgacagaagtcgaagcccgtgtcgttctctgttctcccaagtatcaaagtcggtacactggctctgtgaaagcaatcatccctgtcagcaaagagacaatcaaggcgtattgtgctcttaaaacggcaaccgctaagactactaacaacgctacacccgaaaacgttgcattcgctatctttacctctggcagcactggtcgtgctaagggtattatcatcaaccacaaggcacttgccagcagcggcatggcattcgggcccatggtgcaccttgacgagaattctcgagctttccaatttgcctctcttacttttgatgctgctgtcatggaaacactcgtcaccttgatgcacggcggttgcgtgtgcattccaagcgaagatgaacgcttgaatgatgttgctggcgctattcgtcggatgaatgtctcttggtcattcctgactccatccatagccagtatcattgaaccgtcatccgttccatctctgagggatcttgtgtgtggtggagagaagatgtctcgcgaagtcatcaccaaatgggcacatcgggtaaacctgatgaatggatatggtccaactgaaactactatcttcgcggttatcaacacagatgttgctgccaatccggatcccgcctgtatcggccatggcattccttgcaccctaacctgggttgtcgatcctgacgaccacaacaaactaactcctctaggggctgttggtgagctggcactggaaggccccgcacttgctagggaatacctcaagaaccctaagaagacagcagaggcttttgtggatgagccggagtggattaaggccttccctagtgtcctaccttcgcccagaagaatatacaagactggagatcttgtcagatacaactctgacggttccattcaatacatcagccgcaaggaccatcaagtcaagcttcacgggcagcgcatggagcttggagagattgagcacagactatatgaggacccgcgagtccgccacgctgtggtcttactgccaacggcaggtcccctcaaacagcggttggtcactgttctttcactgaattctgtaactgcggagaaaagcatcatatcagacaatgcatgtgaacttgtcgatcggggtggatctgcacgggcagcataccaggagctcgttgctatccagaagagcttagagacacagctaccaatctacatggttccacaggcttgggctctgatcaagcagctcccaatgctcgtgtctggcaagctagacaggaagcgaatcacagcttggctggagaacgttgatgatgctgcttatgatcgcataatggaggattacgacaacataaaacgtggggatgtcgagcaagacgaggagaaagaggatgaccgagagacttctgtcaagcttcttcaggaagtcttttcccaggttctcaacttaccatctcacaaggtgggcttgaacaggtcatttgtgagcctaggtaagcaaagccataatggtaacggagtgtggagagttgctaatagtgcggtgcaggtggtgatagtatcactggaatggctgtcatttctcgagcgcgtaaacatggactcacgctgaccctccacaatgtgcttcagtcgaagtcgataaaggagctttctctagctgctcagacaagcgtcaagacagtgaaaagagaggagaagcctcatgaatacttcgaactgtctccgatccagggattgttcgttcaaacaacaacaaattttcgggattcttctcgctttaaccaaagcatgacagttcgcgttactcgaagggtcgagccaactagaatgcaacgcgccatcaaggctgttgttgaacagcactccatgttccgagcacggttgttcaagtctcgcgacggaaagtggaagcagaagatcagtgatgtatgtctagcttctccctcgctaactctgtttgggtaccggaagcttactgatttaggatgttgatgcctcataccgcttccgtcatcatatggtggaaaataaagatgcaattctccccaagatcgccgagtgtcaacggtctgtagatgctcaacatggacccatcgttgctgcagacatgttccaagtacgcaacggcatcacaatacttttcctagtggccagtcatctatgtgttgacatggtatcctggcgtattgtcctccaggacatccaagatttcctcgatgctggatcattgtccccggagaagcccctgtcattccaagcttggtgcaaccttcagcttgaacagagcaagaaaccaaatggcagagtccagctgcctttttctattcagcctcccgacctgaaatactggggcatggagcagtcccagaatctctatggggatgtcaagatggaagggttcacgcttgatgccgcagtcacgacacaaatcctcgcagcctgcaataaggttctacgcaccgaggctattgaagtcatactctccgctgttattcactctttccgtcgcacgtttactgatagagaaatgccgactatttacaacgagggccacggtcgcgaggcgtgggacagctctatcgatctctcaagaacggtgggctggttcacgactatgtgtccactgcatgttggtgaagggtcgggtaagtctaattctagcctatcaacggagcaatttctgactgctatagatctacttgacactttgaagcgtgtcaaagacacaaggcgtcacctcagcagtaagagccggtcatactttgcggaaagcctgcttcagccggaaggtaaagagggcgatgctttctctgtcccgctcgagattctgttcaactaccttggccagctgcaacagctagagcgcgatgattcgcttttccaacattatggtgaagccttcaacgcggagaccttcgagatgacaggggacatgggctcgaagacacctcggtttgctctcttcgagatctcggcgcttataatcaagaacaagcttcaggtatcgttcacttacaataagcacatgcagaaagaacagcggatcaagggctggatatctgagtgtaaacgagtgctggagcatatgtctcgtttcgagagcttcacatctgagccgacactcagcgattgtcccttactccccatcacttacgaaggcctgaacaacatggtcaagagagcattcccaaagattggaattgatagctgggatcaggttgaggaggtttatccctgctccccagtacaagaaggtatccttcttagtcagcttcgagacccggaggaatacctgttccatgtcatctttgaagtgcacccatccaagggtagcaaggtggatacaagcaagcttcgaaaggcatggtccatggttgtcagcaggcaccctatcttacggtctgtcttcattgacagcaactacaaaggcggatctttcgaccaggtagtggtcaagtcactcgacgatgaggtcattgagttccagtgccctgagtcggatgcattgggtacacttggggaaataaagctgcgcgatatcaatgctgagagatcgatgaagctcgcccaccagatgaccctctgcaaaacaacttctgggcgagtcctgttcaagattgagatgaaccatgccattatcgatggcgggtcggttgatctgcttcttcgggatctcgccctcgcatacagtgatcagctttctgccggaaccggtccacgttttagtgattatgtcaagtatatcagggaacaatcccagggagaagcagtggcacactgggtgaagtatctttctggcgtgcgaccttgtcacctcctggtatcttccaaaaagagcggtagccaccagctcggcgagcgcatgatatctttcaagcgcttctctgagttgcaaagattctgcgaggaaaattccgtcacactcgctaacttgaccctctgtgcctgggcaattgtactccggaattgtacaggatctgatgatgtctgcttcggatatccgtctgctggtcgtgactcccctgttcctgggatccaagatgcggtcggtatcttcatcaacatgttgtgctgtagagtcaaattctctcccggacaaactcttcttgagattgccaagaaggtacaggatgactttgtcaggaatgtgccgcatcaacactgctctctggctcagatccagcatgagcttggaatgcatggagagacgctcttcaactcaactctttccattcagaatcgctctgccaacaaaggcactagaaatttgccgctcgacttcgaagcccaaaaggcccatgacccgactgaggtgagttgataccgtctcgagcgtagacgcgagctaaccattgatttagtatcctgttactgtaaatgtggagactaccaagggcaaggagggagttttgctgaggtactggagcaacgcagtgaccgaagcacaagcaaaggagctagcggaagctgttaacaaggtctttacatgcttcatcgaggagccatccaagctggtatcgagcttgaacctccttaacaagctaccgcggaaccgttcgcagcacacgcacagggagccccttattttggaccagttgattgacagtcaggtcctacagaagctaattgacgatcgcgtgaatgagataatcagccaaatgctgaaggaaggcaagctcgccataccccttcctgatcagaagactagatactcgaacagctctgttcaactcaagatggtcgaggcttcgctccaggaggatcccataatagacgaaaaggatcttgcaaactcaacaccatccctaacagatgatggcagaagctcaagtgacaatgataggcgcctttgggacctgtggaagtcgacattagggctatcttcagacactatccaataccggagtagctttttcaagctaggcggtgatagtattacagcaatgaagatggtcagcgctgcacgagaagagggcttgcaaatgacagtggcggatgtgttcaacaacccgatcttcgaggacatgctggctacgattactccgagcagcagcccgacctcaaacgccgatacccagtgcgcaaacaacattgaaaaactcctggaggttaatgatgcccttccagatgctaccccaccgcaggatatctcggtgcttaggccaatgcagctcgatgccatgtctctgcttgatgtcatctgccctaagataggggtgttcaaaggaggaattgctgatgttctccctgttacggacttccaatccatgtcgatcgctgccacgctcttcggatcgaggtggatgctgaactatttcttcctcgatggaagtggtcctctagaccttcgacgactgagggaaagcttcttgagggtggtcgatgctttcgatatccttcgaactgtttttgtctgccaccacgggcagttcttccaggtggtgctgagaaaagtccgaccggacatttttgtgcatgagacggagcagagtctagatgagtacaccaacagcttacaaaaacgggaccgcgaacaagatccacgccaaggtgagcagtatgtgcagttctacgttgtcaagaataagaatagcgaccagcatcgcatcttgatcaggatgtcgcatgcccaattcgacggcgtttgtctgccaaagattatgaacgcaatcaagctgggatacgagggcagcaccctacctccagtcttctccttttcgaactatatgcggatgcttcctggaaacatcaccccggcacactaccaccactggtcaacaatactcaagggctctaagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatctccaagatcaacagatcgccaacatgccctatgagtcgctaggattcagggagattatccggaactgcaccgattggcccgactccacatacttcaccacctccgtgtttcatcagaatgtcgagtatgagggacagatgcatctagacggcaattcgtaccggatgggaggcgttggtgttttggacaacttcactgatctcacgctggcctccaaatcctgtggtcaagagaagctcgatgtctcaatcgggtactcgctcaaaggccccattccagcaaccttcatcgctaaagcccttaacatggtttgcgagactgtgcagagcctgattgccaatcccagcgtcccacttgcctcccctgccactatccgctccctgcctagccaagtcattcgtgaaacacccagggcatctgatacacccttcctctcgtcaaatctaaacagccagaagatgtcggagattgtaattcactcagatatccttacccggtcctggcagcaggtgctaccccgtcggactgacaacccacaataccaactcgatgcatctttcttcgacctgggcggagacatcatgaatgttgcccaactggtctggatcctgggagaagaaggcttcagtgtccgtttggaagaccttctcgagcaccatacgttcctgggaatgatggccgtgatggcgatgcaccacaagccggaactgaatgccagaatggcagcgaccatggctgaagaaccagccaaggacatgagaatgactatgacaaagagcaacagctggagctcgctgggcaaagcgatgacgcttgctaagagatttactagatggggggctgtagcagccaaaaagtgaggtttacattcattgtggaggatacataacataacacactctttcgatttctaacatgtactattctgtttttttctgtaacgcatataattgtgtcgaactacattcctttttgtttccatgtttgccgttgaatattgactgtcttcttttgcaaactagatcgtatgatgatgatgatctagatctcttgttattaaaagctcatttgataatctgtgttttcatagatctgttttgactacagctcatcatcttgatagttttaaaccctcccaactagtctgggattggtagagaatgatatagagactatgtttataccatcattccccaccactattattaccatggactatgtactgttaggatcataccacatgggtattcaccaacaaatgcacttaaggctccgcgacgcaatgagccaccttaactatgctgcacaataccatacaattacattacatgtcaagacgaagggtcaagaacatatggatttgatctatctagatctcaagaagatggttggtggttggaagaggtggtggtcagagaccacgcaggaagaaaggcgaaggatcagctgacagctgcctggctgcagtgaatgtctcaacattacattatgcgttcgccgctgtatgagggaaccaagcgccgcgctgcggcagcctaggctcaatttgactagaggaaccactttggtacagcattacaggcatccatacaaccaaggcagacctgagtagactgcattaatcactatacgtagatgcaaaaacgatagctatatctaaatcattccatttaactaaacctagacattaatcggtgataatacgttattcctgtctatcaaaaccccggccgtgctatgcgtgtcatgccatataaaacaaatcaaaccaaacaaaaccagaggtatctcgagcaatccgacacaaaatcccagtgaacaaaacttttataaatcttacccgcttcatttcaactttggaagactggcatagaatggacgtgggggtatatgtg

SEQ ID NO: 20 - DNA, 17556 bp, Aspergillus niger
atggcccaacctgtctcttgttgcttgcccaagtttggcacgagcactcatgggccaaggcggcctgcttcgttgaggatcaggacgagtccttcccagactctccagttgctagccgcttgggaccaatccgagttagattctttactcaaggccacttgggccttgcttcttcatcgctatactggcctagaggacatttgctttggttaccaaccgattggagttgatgccggtccccgcgatactgttacttcttccgatacccataataatattcccttaacttttaatctgaccattaccgaggacgactctgtccatgccattttgcgcaacacaaaaaagcagaacgaagctgaaaaatgcggaagttcaagctcgagttgccacagttataccctgtgcaatacccttctaatgctgcgcaactgtcgcagtgttacgaaagatcccagagcccctcttgtgcaaccggccttggcaattcccttgcccgaaaagtgccgcgtcaggctgcacgtcaaagtcctgcagaaggatgtcggtatcttcttcgaatggtggaacaatgatatgtccactgagcatatgaagagcgtcgccgactacttcgagcagatactttcacgcgtactctcggcagaagatactgccgcgagggacctgaaccatttctcagatcgagattggtccagagtctgcaatttcaactctaccatcccccaggcacatgaccgctgtatacacgaggtcattcatgagcaagtcctggctcgccccggaagtgaagcagtttgtgcgtgggatggaagtttgacctaccaagatctggatctcctgtcatcccaagttgcttatcaccttcaagcacacggagtcggccctgaaaaatgtgtcgctctgtgtttcaacaaatcaaaatggaatgtagtggcaatgctgggtgttctgaaagctggcggtgctttcgtcccccttgatccaacacatccaacctctcgtctacagtcgctggtgcacgctgtgcaagccaaggtcatgctttgctccagagaccgaataggagaattgactggggtagcggagatgataataccactggaccaggctatcatagacgaaatctcccttcaagctgaagaaatctactcattgccggatgtacaaggtcacaatgcagcctacgtgatattcacttctggatcaacaggagaacctaagggtaccatgctagagcacagagcctatgtatccggagccgctgcccatgctggaccgcaccatatgttttcgacttcacgcgtcttgcagtttgcggcacacacgtttgatgccagtcttgtcgagatcttgactaccttgttgcaaggcggctgtgtctgcattccaagtgaagaagaacgcttgagtgacatagtcaaggtcatcaacgagatgaacataaaccatgctattttgaccccatcctttgttgagttcattgattcctcgcaagtcccaggtcttgagaccttgattcttgctggagaggcgatgtcacaaggccagctggaaacatggtcgtccgccctccacctcatcaacgcctatggccccacagaaagctctgttgctgccgttgttaacgccaaagttacaccatcttctgattgtcgggatattggactccccgtgggcgtacgttgctgggttgtagacccgagcaatcatgaccaattagtacccgtgggttgtccgggtgaattactgcttgagggaccgacgctcgctcgatgctatctcaacaatcctcagaagacaagtgaagcgttcatccatgatccagcctggatgagaagggacggattaaatgactgtaaccggagagtgtacaagacgggtgatctggtaagatacaactccgactgtggctcactgacgtatataggcagaaaagacacgcaggtgaagtttcatggacagagacttgagttgggcgagatagaaaaccagctggctgccgacccaattgtcaaacactgtctagcttttctttcgaagtcagggttctctgcaggcaaattggtggcggtaatatccttatctgttcacttcgaatctcaaccggaatcaaatgcagcgccactcaagctccttgatacatcgaagaagacctctatcgttgcagaagttcgcgagagattatcagctaaactaccaacctacatgataccctccgtttggctgtgtgtggaggcattgccgttgcttccgtctgggaagctggacagaaaggcgaccgcaagatggattggagatatggagcgagacccgtatgcccaagctataagcgccaggactttgtctgcggataaagccacacttccttcgagtgccacggaggacaaactcgctgcgatctggagccgggttctcaatatcccccgaagccaacttgcccttgacgaaggctttttgagtctaggtggagactctattgccgccataacgtgcctcgggtattgcaagaagcaaggaatgggcttgacggtacaagaggtgcttcatagcaagtcaatcaaggagctggctactcgggtaaaacagatcgatcaatttgttgtgtacgaagaaaagatcgatgagccctttgacctttcaccaatccagaagcttcacttcatggtccgaaacgagggccaaggccacttcaaccaaagcattcttacacgcctgaaccggcacattgatgagcatagcatgcgacgtgcaattgagaccattatcaatcgtcactctatgctccgctctcgcctggtcgaatcagacgttgaggggataatgcggcaaagaataactcaagacgtagcagggtcttaccgttggcgttctcacaacaacagcaaccgaagcgaggtcgaccatgctatctcgaacagccagtcatgcatcaatgccttcgttggccccgtacttgcaatagatgtcttctatggaaatgaccattcccgcctgctgtcactcgtggctcatcatatggtagtcgacattgtttcgtggaggattattttggaagacttggaagacctactgatgaaccccgatcaaccgatatcacagaacggctcccttccgtttcagaactggtgccaaattcaagcagatcgttgtcaagaagcgacagctgaacgaaccatggatctgcctgaagttcccgcacccgattttgcctactggggactaaaaagccaccaaaccacctatggcgatgtggattgtgaaacgttcgatcttgacagtgatattactcgccacatactgactgggtgccacgaaagtcttcaaacagagccaatcgatctttttctagcagctttgctacactccttcggcgaaacgttcaaagaccgatcattgccagttatatacaatgagggacatgggcgagaagtctgggactcatcaatagatatctctcgcactatcggctggtttaccacactgtatcccattcttctatcggaacttcctgcaaaagatccaaccgaaacggttgtacgtgttaaggatttgcgacgttgtgttccggacaatggtcgacatgatttcgctcgtcgtatgttggttccacgcgaagatgggacttgtcggcactatagccccatggagatgtctttcaactatgtgggccagcaccgtgacctacagagaaaggatgggctcttccaactcatggatcagatggctggagaaacaggccgcggaggtgcagcggctgattttggtgaagaaactcctcgctttgcactgttcgagatatctgcgatggttgtgcagggtcaacttcgctttatcttctccttcaataggaatatgcagcatcagaatggtatccgtaactgggtacactgctgcaaaacattactggcatccctgggcgaacgcttacaggctctcccaccgaaaccaacgctaagcagtttccccatgttaacattgacatataccgaactcgatgcgttggtgtcgaaaaaattaccggatgccggtattcatagtcttgatgatgttgaggacatctatccttgctccagaatgcagcagggcattctactcagtcgctctcgcgatagctcactttatgctgtacatgacacattcgaaatatccgggccaggaagcacacccgacatcaaccgattgatacttgcctggcagaaagtcgttgctcaccatgcaatgctacggactatatttctggaggggttgagcagccacgacctacattgtcaagtggtgctcaaatcgttcgattcccgcccaacttacgtcgtatgtgcgaatgaaagcgaagtgctacctacatttgacaaacagcaaccgatgagctacgataatagtatacctcctcatcggcttacaatctgccaaacggcttctgggaagctgttttgtcgactggagctgaaccatgtcgccatggatggcgcatcaatctccatcatccttcgggatctgcaattagcgtaccaaggaaagctcgaagaaccaaagccgaagttcaaagagtatatacgctaccttcgtgaggttccccaagtcgcaagtcttgactattggcgcaattatttgttggatgtccaaccttgtcatttccccgtgctcaatgacggcaaaggctctgtaaggcagcttcggaccaagagattgggcggtgtgccattcaaagagctacgaaccatctgcgatatgaatggtctgacccttccgactgcctttagtgctgcatggggattaacggttcgctccttttgtggatcagatgacatctccttcacctatcttgcatcactaagagatgtcccagtagagggcgttgaatatgttgttggacctgtcatcaataccctgacctgtcgtatgctgtttgctaaagggacgtcactgaaggagatcctcgcaaaagttcaacaggataacctggacaatttgccgcacaggcatatctcactcacggagatccagcaagctttgggactaacagcctcattggctaatagtggtatttcttaccggaagcttcccaatcagaatgctttgtcaagcgaggagatacagttctctgaagtggggacaattcacgacccggcagagtcgcccgtttttgtcaatgttgaagctacagaagacgacgcacgtatcgaccttaactactggacagaccacctgtcggacgggcaagcagagaatgtcgcgagcacattccttaaatcggttgaaaatattgtgcaccactttgaggatgacgcccattcaattgacaactttagcgacgcgaacagacaaagcctaatgctttggaatagcgaagtcccaaagtccatcgacaaatgcatgcatgagatagttgatgagtgtgcgaaatcccaccctcacaccatggcaatttctgcttgggatggaaacctcacttatgctaagctcaatgaattgtcatcgctacttgcaacgtacttgacaacactaggggtgggccccggaacaatcgtgccccttgatctcgctagatcctcctggcaagttgtagccatcttggcagtcatgaagacaggtggtgtatgtgttccggtgaacccagcccgactgccacaacatttcgagacttggctcgtcgacaatgagatccaggttgccctagcatcaccgactcaaatgcaactactcgaaggggccgttccatatgtaatttccgtggagagctctctgtttgaatacctttcagacagtgatgcagtttcaagctcaccaattcagccatgcagcgatgcatatatcgtgttcggcgctgagagtcccaagtgcatcttgattgaccatcgtgcaataacaacccgggcaagcgcgttcgcttcaggtcttggactaaatgcacgaacaaagatgctccaatacgctccctatacttctgacatgttccttcaagaagtcttcggcacgttcctgtgcggtgggtctatctgcattccgtcagatgaagacctggcagacctgtcaaaagccatcaagacaatgcaggcgaactgtgtcagtatcacaccctcaatggcgatgactctaagattcgcagaggatctggggataaaggtccttgctttatggggtgaacacccgaccaagcaacttcttaccgccctgcctggaggaatccaagtgcatgcattctatggaacgccagaatgctcatcttcttgcattcgatcctctcagcttgacggatcatgcgaatcgtcaattattgggtcaagtcttggatgtaaatcttggcttgtagatccctccgatcacgatattttggttccgatcggctgcgttggcgaattgatgatagaaggcccaagtctttctcatggttactatcaagatgcggaactcacgcaacaatatttcgtcgaaaatcccttttggagactggcatacgaatcccagccatcatcagacaaagacaagaacacggacgcccagaagctgtcctatcgattgttcaagactggagatcttgctcgctacaactccgatggcacactcgtttacgttggtaagaaagatagaggattgcattggcagcgacagacagcggccatttacgtcgaagagcaaatcgcatctctctcatccttcaatgcccagtatgtcgttgaggagatcagcaagagaaatgtcgattctccccgatcgtctctggccatctttttctctgatgaggccgtcgactccaagggacaccaccagcctattgcacaattgtcacctgagctgcacgactcaatgatcaggctgtataaaaagctgtcgagctccttgccagcgaattctgtcccgagactgtattttccgacgtctagcataccactgaactcgttcggtaagctagaccgccagctgctgagaaatgcagctcaaaatctgccagaaggattgctgtctagattcgacatcaaaagctttgacagcttctggaaagggcagctggccacattggcggtttcgccagtgttcccgccaccccgtggctctttgtctcagccgagcacaccggtcaccaagcaagcaacaagaaacatgcagatggtctggtgtgatacactcagatcaatgaccgaaggtacacgatgtgctatcctttctgcatgggctcttactattcgcggctacaccagctcccgtgatattgtttttggggagttgctgtcagaagttgaattggcctccactgagcgtcaggacaattatacgcaagctgcaactatcgttccccgacgcttccaactcaacgatgattggaccgttactgagctactgagcagggtgaagaaccaactggagtcagctaagccctaccaatgggctggaataagtcaaattcagaaattgaacgctgatacggcgcgcgcctgtgatttcatgaacttgatctctataacggacaatcgtggccttgaaccaagtctagtacccatgaaacagcatgacagcaatctgtccggttatcctttgatggttgattgtatccttggagatgctacgctcgaactcttgattagttacgatgacagcactttaacaggcacccagatcgagcgactggctgcccaattcttcgcttgtgttggacttcttaactccaaggctagcatgagcaagacaattggtatcttgtccagagacaacatggacttttgctccttccgccatgatgttgcctactggaaaaactacttggaggatgttgaagcttgtcttttcccggcactacgtgcacgtgcggaggaaaatactcatgctgagactcagataatactccagaacaccaagcatctacatgatctcagtgaacgtgaacgtctcagcaaaagctcacttcttcagcttgtttggggcttggttctgcgatgctacacaggcctacaagatgtgtgcttcggatatcacatttcagatgcaagcgacagatctgccaagcctggagttgcgaataagccagatatttcaggtacattcccgtgcagaatgctcttgaatggtgaatctagggttgcggaaattttgagagagcgactgcaaggactgaatcaaatgcagcagcatcggttgccgtgggatgaagtccagcaagagcttgggtgtagcgacattttcaataccgttttcacttgttcagaacaatcaagtgacgcagtaaatgtggctggtctcgctgatcttgatccgagcaaatacctgattaccgtcaacgccactctagcagaatcatcaggagtcattaggttcggctatcaaaggaggcacttctcagaaaccgacatggaaggcgtccttgattgttttaataatattctgggacagttactccaatttcctcttccggatcttttggtaggcgaggttgactttgtgagtgagctttcctgccagaagatatctgagtggaactcggcgctgccagaccgtccagtgctatgcgcgcatgagctcatccaacagcaagccttggatcgtgctacggctcctgcaatttgttcttgggatggcaacttcacatatgcacaacttgaccgattgtcgactctcctagcaaaccagctggtgggcttaggggtcaagcccgacatctttgttgcattgtgtttcgaaaagtccgcatgggcagttgttgcacaggttgctgttttgaaagctggaggagccttcgcttcattagatccagctcacccagaaagccgcctacaaggcatgatcgatgatcttggcgctcaggttattctctgttctgagacacactacgagagagcctccagcatctgtcgtcgcgcaatgatcgtaagcaatagcgcacttgaacaactttaccactcaccctttgctgctccgacccaagaggtaaccgctgataacgcagcctacgccatattcacatcgggaaccacagggaaacccaaggtgacagtacttgagcatgttggacttaccctagcctgcacagagctctccagggccttcttcataagttcagaaacacgcgctctgcagttctcaagctatacattcgacgtcagcatattggaaactatcatagtccttgctgctggtggttgcatttgtatccctagcgaagatgagcgcatgaacaatctttctggagccatcagaaagatgaacgtcaacttcatgagctgtactccatctatcgttaataccatggaccccaatgctgttccttcattgcgaacaataactctcggaggagaaaaaatgactgcaagccatttcgagcgatgggctgacaggtgtgttattaacgcgtacggtccgtcagaggctactgtcgcctttacgtcaagcacaaaatacgaccatgcaggagtacgccttactgatgactatggttctattggcactgctatttgtggcaggacatggattgttgatccccaaaatcacaatcgacttgtgcccatcggcgcacccggagagctcgttcttgagagttgcactgttgctcgtgggtatctcaataatgacgggaaaaccaaggctgttttcatccgggacccggagtggactcagcgtgaagggctacagcatgtgttgaggcgcaaagaacggatgtatcgcacgggagatttagtgcgctacaactccgacggctcgattgctttcatttcgcgaattgatacacaagtgaaattgaacggtgtgcgcatcgaattggaagaagttgagcaacaatgcaacaactatctttcgacagatactcaggttgccgttgaggttgttactccagaggccaaaactatatcaaaatgcttggctgtcttcttcaccattgacgagcaccaaatgaaagatatggcgaatggtgaattcattctgcccatgtcagagtctgtagttcacatggtcaagaagctacacggttccctaagcgcttcattaccgctagctatggtgcccaagctttacttccccatgcggcgcctgccgtttggaagcactggcaaaactgatcgcaaagcacttcgagcaatggtcgatacatttaccaaggaacgcttgagaccatatgttatcttcaatgttggcacagaagaacgctccgatgtgggaacggaagggacagagggcgttctcaagacgctatgggaggaagtccttaaccttgcgccaggttctatcagtgccgaagacaacttcttcggcatgggtggcgactcgttttctgctatgaaactagtcgtagccgcggcatcccagaatatttcacttgcagtggccgacatataccgaactcctatattcaaagacatggcaaagacatgtggagcgggtgaggtacagactggcgtaccaacagtggaccctttcagcatgctgcctgaatctctttcacgcgatgatattctggaggaagtctctgatcaatgtggtgtgcctatggatcgaattgcggacatctacccttgtagtccggtgcaagagggcttgctcacactttctatcaaacaacccggagcctatgtcgctcgacctgtgttccaactcgcagagggagctgaccttgacaagtttaaagctgcatggcaaaaggtggttaatgaaatggatattcttcggactcgggtagtacacaccgagtccgccaactttgtccaggcagtgctcactgatgtccctatcctctgggaaacggcaacggaattggatgatttagcaaacgacactattgacctagccaagaataacgggggcttgctaactggatacgccattgtcgagtccggacactcgcgctccttcgtttggaccatacaccacgctctctatgatggatggagtgtgtcccagatccttcaacgagttgaggagatatactcgggtgcttcaaaacttagctcgacgcttccttacaagctctttatcaatcacctggtccagcaagaggctcattcctcggacgaattctggaagacacacctcgcggccctgtcttcatgtcctttcccccagaacaagccgtcacctgataccattcgcgtcggcaatcggcattacagctcgcttgagatttctcatgcaccaagtgggcctaatttaaccgttcctgaaatgatacgagctgcatgggcactaattgtatccgtccacaccggttccggagatgtctgcttcgctgaaaccctaatgggtagaaatattgatatgcctggggctatggaagttgcaggacctcttttgacaacggttcctatacggatggctgtcaacaacgagctctcgattattcagtacctcgataatgtgcgccagctgaccacaatgatgctgccgcatcaacattctgggctccagaggattcgcaagctaagcagcgacactgcccttgcttgcgaatcccaaaatctactggttattcaatcagaacaggcccattcgaacacaagtatctgggagcaaaaggataacctgactgaaggcgaatttttcacccacccaattgttgtcgaatgcaaggttggcgaatcgcaggtggccgtaacccttcatcacgacgagcttgttttcgacagttggcaggctaagatgctcattgaacagtttaccttcgttttgagtcaactgttatcaatctccaatgaagaatccagaaagatcggagagctagaggtttccagttctcgggataaggaagaaattgctctctggaatgagagaaacctgacttgcatagacagatgtgttcatcatatcattgaggagaaagcatccctccgacctcaagctcaagccgtctgctcctgggatggacaactaacttaccaggagctttaccagcttgcttcttcgtttgcagcttacctgaaaactcgtggcgtcggtccggagactttggttccgatctgtatggacaagtctttgtgggccattgtcacaatactgggtgtcctcattgcgggtggaggatatgtcccccttgaccctgctcacccaacgtcaaggcacaaggagattctgacagaagtcgaagcccgtgtcgttctctgttctcccaagtatcaaagtcggtacactggctctgtgaaagcaatcatccctgtcagcaaagagacaatcaaggcgtattgtgctcttaaaacggcaaccgctaagactactaacaacgctacacccgaaaacgttgcattcgctatctttacctctggcagcactggtcgtgctaagggtattatcatcaaccacaaggcacttgccagcagcggcatggcattcgggcccatggtgcaccttgacgagaattctcgagctttccaatttgcctctcttacttttgatgctgctgtcatggaaacactcgtcaccttgatgcacggcggttgcgtgtgcattccaagcgaagatgaacgcttgaatgatgttgctggcgctattcgtcggatgaatgtctcttggtcattcctgactccatccatagccagtatcattgaaccgtcatccgttccatctctgagggatcttgtgtgtggtggagagaagatgtctcgcgaagtcatcaccaaatgggcacatcgggtaaacctgatgaatggatatggtccaactgaaactactatcttcgcggttatcaacacagatgttgctgccaatccggatcccgcctgtatcggccatggcattccttgcaccctaacctgggttgtcgatcctgacgaccacaacaaactaactcctctaggggctgttggtgagctggcactggaaggccccgcacttgctagggaatacctcaagaaccctaagaagacagcagaggcttttgtggatgagccggagtggattaaggccttccctagtgtcctaccttcgcccagaagaatatacaagactggagatcttgtcagatacaactctgacggttccattcaatacatcagccgcaaggaccatcaagtcaagcttcacgggcagcgcatggagcttggagagattgagcacagactatatgaggacccgcgagtccgccacgctgtggtcttactgccaacggcaggtcccctcaaacagcggttggtcactgttctttcactgaattctgtaactgcggagaaaagcatcatatcagacaatgcatgtgaacttgtcgatcggggtggatctgcacgggcagcataccaggagctcgttgctatccagaagagcttagagacacagctaccaatctacatggttccacaggcttgggctctgatcaagcagctcccaatgctcgtgtctggcaagctagacaggaagcgaatcacagcttggctggagaacgttgatgatgctgcttatgatcgcataatggaggattacgacaacataaaacgtggggatgtcgagcaagacgaggagaaagaggatgaccgagagacttctgtcaagcttcttcaggaagtcttttcccaggttctcaacttaccatctcacaaggtgggcttgaacaggtcatttgtgagcctaggtggtgatagtatcactggaatggctgtcatttctcgagcgcgtaaacatggactcacgctgaccctccacaatgtgcttcagtcgaagtcgataaaggagctttctctagctgctcagacaagcgtcaagacagtgaaaagagaggagaagcctcatgaatacttcgaactgtctccgatccagggattgttcgttcaaacaacaacaaattttcgggattcttctcgctttaaccaaagcatgacagttcgcgttactcgaagggtcgagccaactagaatgcaacgcgccatcaaggctgttgttgaacagcactccatgttccgagcacggttgttcaagtctcgcgacggaaagtggaagcagaagatcagtgatgatgttgatgcctcataccgcttccgtcatcatatggtggaaaataaagatgcaattctccccaagatcgccgagtgtcaacggtctgtagatgctcaacatggacccatcgttgctgcagacatgttccaagacatccaagatttcctcgatgctggatcattgtccccggagaagcccctgtcattccaagcttggtgcaaccttcagcttgaacagagcaagaaaccaaatggcagagtccagctgcctttttctattcagcctcccgacctgaaatactggggcatggagcagtcccagaatctctatggggatgtcaagatggaagggttcacgcttgatgccgcagtcacgacacaaatcctcgcagcctgcaataaggttctacgcaccgaggctattgaagtcatactctccgctgttattcactctttccgtcgcacgtttactgatagagaaatgccgactatttacaacgagggccacggtcgcgaggcgtgggacagctctatcgatctctcaagaacggtgggctggttcacgactatgtgtccactgcatgttggtgaagggtcggatctacttgacactttgaagcgtgtcaaagacacaaggcgtcacctcagcagtaagagccggtcatactttgcggaaagcctgcttcagccggaaggtaaagagggcgatgctttctctgtcccgctcgagattctgttcaactaccttggccagctgcaacagctagagcgcgatgattcgcttttccaacattatggtgaagccttcaacgcggagaccttcgagatgacaggggacatgggctcgaagacacctcggtttgctctcttcgagatctcggcgcttataatcaagaacaagcttcaggtatcgttcacttacaataagcacatgcagaaagaacagcggatcaagggctggatatctgagtgtaaacgagtgctggagcatatgtctcgtttcgagagcttcacatctgagccgacactcagcgattgtcccttactccccatcacttacgaaggcctgaacaacatggtcaagagagcattcccaaagattggaattgatagctgggatcaggttgaggaggtttatccctgctccccagtacaagaaggtatccttcttagtcagcttcgagacccggaggaatacctgttccatgtcatctttgaagtgcacccatccaagggtagcaaggtggatacaagcaagcttcgaaaggcatggtccatggttgtcagcaggcaccctatcttacggtctgtcttcattgacagcaactacaaaggcggatctttcgaccaggtagtggtcaagtcactcgacgatgaggtcattgagttccagtgccctgagtcggatgcattgggtacacttggggaaataaagctgcgcgatatcaatgctgagagatcgatgaagctcgcccaccagatgaccctctgcaaaacaacttctgggcgagtcctgttcaagattgagatgaaccatgccattatcgatggcgggtcggttgatctgcttcttcgggatctcgccctcgcatacagtgatcagctttctgccggaaccggtccacgttttagtgattatgtcaagtatatcagggaacaatcccagggagaagcagtggcacactgggtgaagtatctttctggcgtgcgaccttgtcacctcctggtatcttccaaaaagagcggtagccaccagctcggcgagcgcatgatatctttcaagcgcttctctgagttgcaaagattctgcgaggaaaattccgtcacactcgctaacttgaccctctgtgcctgggcaattgtactccggaattgtacaggatctgatgatgtctgcttcggatatccgtctgctggtcgtgactcccctgttcctgggatccaagatgcggtcggtatcttcatcaacatgttgtgctgtagagtcaaattctctcccggacaaactcttcttgagattgccaagaaggtacaggatgactttgtcaggaatgtgccgcatcaacactgctctctggctcagatccagcatgagcttggaatgcatggagagacgctcttcaactcaactctttccattcagaatcgctctgccaacaaaggcactagaaatttgccgctcgacttcgaagcccaaaaggcccatgacccgactgagtatcctgttactgtaaatgtggagactaccaagggcaaggagggagttttgctgaggtactggagcaacgcagtgaccgaagcacaagcaaaggagctagcggaagctgttaacaaggtctttacatgcttcatcgaggagccatccaagctggtatcgagcttgaacctccttaacaagctaccgcggaaccgttcgcagcacacgcacagggagccccttattttggaccagttgattgacagtcaggtcctacagaagctaattgacgatcgcgtgaatgagataatcagccaaatgctgaaggaaggcaagctcgccataccccttcctgatcagaagactagatactcgaacagctctgttcaactcaagatggtcgaggcttcgctccaggaggatcccataatagacgaaaaggatcttgcaaactcaacaccatccctaacagatgatggcagaagctcaagtgacaatgataggcgcctttgggacctgtggaagtcgacattagggctatcttcagacactatccaataccggagtagctttttcaagctaggcggtgatagtattacagcaatgaagatggtcagcgctgcacgagaagagggcttgcaaatgacagtggcggatgtgttcaacaacccgatcttcgaggacatgctggctacgattactccgagcagcagcccgacctcaaacgccgatacccagtgcgcaaacaacattgaaaaactcctggaggttaatgatgcccttccagatgctaccccaccgcaggatatctcggtgcttaggccaatgcagctcgatgccatgtctctgcttgatgtcatctgccctaagataggggtgttcaaaggaggaattgctgatgttctccctgttacggacttccaatccatgtcgatcgctgccacgctcttcggatcgaggtggatgctgaactatttcttcctcgatggaagtggtcctctagaccttcgacgactgagggaaagcttcttgagggtggtcgatgctttcgatatccttcgaactgtttttgtctgccaccacgggcagttcttccaggtggtgctgagaaaagtccgaccggacatttttgtgcatgagacggagcagagtctagatgagtacaccaacagcttacaaaaacgggaccgcgaacaagatccacgccaaggtgagcagtatgtgcagttctacgttgtcaagaataagaatagcgaccagcatcgcatcttgatcaggatgtcgcatgcccaattcgacggcgtttgtctgccaaagattatgaacgcaatcaagctgggatacgagggcagcaccctacctccagtcttctccttttcgaactatatgcggatgcttcctggaaacatcaccccggcacactaccaccactggtcaacaatactcaagggctctaagatg

SEQ ID NO: 21 - RNA, 17556 nt, Aspergillus niger
auggcccaaccugucucuuguugcuugcccaaguuuggcacgagcacucaugggccaaggcggccugcuucguugaggaucaggacgaguccuucccagacucuccaguugcuagccgcuugggaccaauccgaguuagauucuuuacucaaggccacuugggccuugcuucuucaucgcuauacuggccuagaggacauuugcuuugguuaccaaccgauuggaguugaugccgguccccgcgauacuguuacuucuuccgauacccauaauaauauucccuuaacuuuuaaucugaccauuaccgaggacgacucuguccaugccauuuugcgcaacacaaaaaagcagaacgaagcugaaaaaugcggaaguucaagcucgaguugccacaguuauacccugugcaauacccuucuaaugcugcgcaacugucgcaguguuacgaaagaucccagagccccucuugugcaaccggccuuggcaauucccuugcccgaaaagugccgcgucaggcugcacgucaaaguccugcagaaggaugucgguaucuucuucgaaugguggaacaaugauauguccacugagcauaugaagagcgucgccgacuacuucgagcagauacuuucacgcguacucucggcagaagauacugccgcgagggaccugaaccauuucucagaucgagauugguccagagucugcaauuucaacucuaccaucccccaggcacaugaccgcuguauacacgaggucauucaugagcaaguccuggcucgccccggaagugaagcaguuugugcgugggauggaaguuugaccuaccaagaucuggaucuccugucaucccaaguugcuuaucaccuucaagcacacggagucggcccugaaaaaugugucgcucuguguuucaacaaaucaaaauggaauguaguggcaaugcuggguguucugaaagcuggcggugcuuucgucccccuugauccaacacauccaaccucucgucuacagucgcuggugcacgcugugcaagccaaggucaugcuuugcuccagagaccgaauaggagaauugacugggguagcggagaugauaauaccacuggaccaggcuaucauagacgaaaucucccuucaagcugaagaaaucuacucauugccggauguacaaggucacaaugcagccuacgugauauucacuucuggaucaacaggagaaccuaaggguaccaugcuagagcacagagccuauguauccggagccgcugcccaugcuggaccgcaccauauguuuucgacuucacgcgucuugcaguuugcggcacacacguuugaugccagucuugucgagaucuugacuaccuuguugcaaggcggcugugucugcauuccaagugaagaagaacgcuugagugacauagucaaggucaucaacgagaugaacauaaaccaugcuauuuugaccccauccuuuguugaguucauugauuccucgcaagucccaggucuugagaccuugauucuugcuggagaggcgaugucacaaggccagcuggaaacauggucguccgcccuccaccucaucaacgccuauggccccacagaaagcucuguugcugccguuguuaacgccaaaguuacaccaucuucugauugucgggauauuggacuccccgugggcguacguugcuggguuguagacccgagcaaucaugaccaauuaguacccguggguuguccgggugaauuacugcuugagggaccgacgcucgcucgaugcuaucucaacaauccucagaagacaagugaagcguucauccaugauccagccuggaugagaagggacggauuaaaugacuguaaccggagaguguacaagacgggugaucugguaagauacaacuccgacuguggcucacugacguauauaggcagaaaagacacgcaggugaaguuucauggacagagacuugaguugggcgagauagaaaaccagcuggcugccgacccaauugucaaacacugucuagcuuuucuuucgaagucaggguucucugcaggcaaauugguggcgguaauauccuuaucuguucacuucgaaucucaaccggaaucaaaugcagcgccacucaagcuccuugauacaucgaagaagaccucuaucguugcagaaguucgcgagagauuaucagcuaaacuaccaaccuacaugauacccuccguuuggcuguguguggaggcauugccguugcuuccgucugggaagcuggacagaaaggcgaccgcaagauggauuggagauauggagcgagacccguaugcccaagcuauaagcgccaggacuuugucugcggauaaagccacacuuccuucgagugccacggaggacaaacucgcugcgaucuggagccggguucucaauaucccccgaagccaacuugcccuugacgaaggcuuuuugagucuagguggagacucuauugccgccauaacgugccucggguauugcaagaagcaaggaaugggcuugacgguacaagaggugcuucauagcaagucaaucaaggagcuggcuacucggguaaaacagaucgaucaauuuguuguguacgaagaaaagaucgaugagcccuuugaccuuucaccaauccagaagcuucacuucaugguccgaaacgagggccaaggccacuucaaccaaagcauucuuacacgccugaaccggcacauugaugagcauagcaugcgacgugcaauugagaccauuaucaaucgucacucuaugcuccgcucucgccuggucgaaucagacguugaggggauaaugcggcaaagaauaacucaagacguagcagggucuuaccguuggcguucucacaacaacagcaaccgaagcgaggucgaccaugcuaucucgaacagccagucaugcaucaaugccuucguuggccccguacuugcaauagaugucuucuauggaaaugaccauucccgccugcugucacucguggcucaucauaugguagucgacauuguuucguggaggauuauuuuggaagacuuggaagaccuacugaugaaccccgaucaaccgauaucacagaacggcucccuuccguuucagaacuggugccaaauucaagcagaucguugucaagaagcgacagcugaacgaaccauggaucugccugaaguucccgcacccgauuuugccuacuggggacuaaaaagccaccaaaccaccuauggcgauguggauugugaaacguucgaucuugacagugauauuacucgccacauacugacugggugccacgaaagucuucaaacagagccaaucgaucuuuuucuagcagcuuugcuacacuccuucggcgaaacguucaaagaccgaucauugccaguuauauacaaugagggacaugggcgagaagucugggacucaucaauagauaucucucgcacuaucggcugguuuaccacacuguaucccauucuucuaucggaacuuccugcaaaagauccaaccgaaacgguuguacguguuaaggauuugcgacguuguguuccggacaauggucgacaugauuucgcucgucguauguugguuccacgcgaagaugggacuugucggcacuauagccccauggagaugucuuucaacuaugugggccagcaccgugaccuacagagaaaggaugggcucuuccaacucauggaucagauggcuggagaaacaggccgcggaggugcagcggcugauuuuggugaagaaacuccucgcuuugcacuguucgagauaucugcgaugguugugcagggucaacuucgcuuuaucuucuccuucaauaggaauaugcagcaucagaaugguauccguaacuggguacacugcugcaaaacauuacuggcaucccugggcgaacgcuuacaggcucucccaccgaaaccaacgcuaagcaguuuccccauguuaacauugacauauaccgaacucgaugcguuggugucgaaaaaauuaccggaugccgguauucauagucuugaugauguugaggacaucuauccuugcuccagaaugcagcagggcauucuacucagucgcucucgcgauagcucacuuuaugcuguacaugacacauucgaaauauccgggccaggaagcacacccgacaucaaccgauugauacuugccuggcagaaagucguugcucaccaugcaaugcuacggacuauauuucuggagggguugagcagccacgaccuacauugucaaguggugcucaaaucguucgauucccgcccaacuuacgucguaugugcgaaugaaagcgaagugcuaccuacauuugacaaacagcaaccgaugagcuacgauaauaguauaccuccucaucggcuuacaaucugccaaacggcuucugggaagcuguuuugucgacuggagcugaaccaugucgccauggauggcgcaucaaucuccaucauccuucgggaucugcaauuagcguaccaaggaaagcucgaagaaccaaagccgaaguucaaagaguauauacgcuaccuucgugagguuccccaagucgcaagucuugacuauuggcgcaauuauuuguuggauguccaaccuugucauuuccccgugcucaaugacggcaaaggcucuguaaggcagcuucggaccaagagauugggcggugugccauucaaagagcuacgaaccaucugcgauaugaauggucugacccuuccgacugccuuuagugcugcauggggauuaacgguucgcuccuuuuguggaucagaugacaucuccuucaccuaucuugcaucacuaagagaugucccaguagagggcguugaauauguuguuggaccugucaucaauacccugaccugucguaugcuguuugcuaaagggacgucacugaaggagauccucgcaaaaguucaacaggauaaccuggacaauuugccgcacaggcauaucucacucacggagauccagcaagcuuugggacuaacagccucauuggcuaauagugguauuucuuaccggaagcuucccaaucagaaugcuuugucaagcgaggagauacaguucucugaaguggggacaauucacgacccggcagagucgcccguuuuugucaauguugaagcuacagaagacgacgcacguaucgaccuuaacuacuggacagaccaccugucggacgggcaagcagagaaugucgcgagcacauuccuuaaaucgguugaaaauauugugcaccacuuugaggaugacgcccauucaauugacaacuuuagcgacgcgaacagacaaagccuaaugcuuuggaauagcgaagucccaaaguccaucgacaaaugcaugcaugagauaguugaugagugugcgaaaucccacccucacaccauggcaauuucugcuugggauggaaaccucacuuaugcuaagcucaaugaauugucaucgcuacuugcaacguacuugacaacacuaggggugggccccggaacaaucgugccccuugaucucgcuagauccuccuggcaaguuguagccaucuuggcagucaugaagacaggugguguauguguuccggugaacccagcccgacugccacaacauuucgagacuuggcucgucgacaaugagauccagguugcccuagcaucaccgacucaaaugcaacuacucgaaggggccguuccauauguaauuuccguggagagcucucuguuugaauaccuuucagacagugaugcaguuucaagcucaccaauucagccaugcagcgaugcauauaucguguucggcgcugagagucccaagugcaucuugauugaccaucgugcaauaacaacccgggcaagcgcguucgcuucaggucuuggacuaaaugcacgaacaaagaugcuccaauacgcucccuauacuucugacauguuccuucaagaagucuucggcacguuccugugcggugggucuaucugcauuccgucagaugaagaccuggcagaccugucaaaagccaucaagacaaugcaggcgaacugugucaguaucacacccucaauggcgaugacucuaagauucgcagaggaucuggggauaaagguccuugcuuuauggggugaacacccgaccaagcaacuucuuaccgcccugccuggaggaauccaagugcaugcauucuauggaacgccagaaugcucaucuucuugcauucgauccucucagcuugacggaucaugcgaaucgucaauuauugggucaagucuuggauguaaaucuuggcuuguagaucccuccgaucacgauauuuugguuccgaucggcugcguuggcgaauugaugauagaaggcccaagucuuucucaugguuacuaucaagaugcggaacucacgcaacaauauuucgucgaaaaucccuuuuggagacuggcauacgaaucccagccaucaucagacaaagacaagaacacggacgcccagaagcuguccuaucgauuguucaagacuggagaucuugcucgcuacaacuccgauggcacacucguuuacguugguaagaaagauagaggauugcauuggcagcgacagacagcggccauuuacgucgaagagcaaaucgcaucucucucauccuucaaugcccaguaugucguugaggagaucagcaagagaaaugucgauucuccccgaucgucucuggccaucuuuuucucugaugaggccgucgacuccaagggacaccaccagccuauugcacaauugucaccugagcugcacgacucaaugaucaggcuguauaaaaagcugucgagcuccuugccagcgaauucugucccgagacuguauuuuccgacgucuagcauaccacugaacucguucgguaagcuagaccgccagcugcugagaaaugcagcucaaaaucugccagaaggauugcugucuagauucgacaucaaaagcuuugacagcuucuggaaagggcagcuggccacauuggcgguuucgccaguguucccgccaccccguggcucuuugucucagccgagcacaccggucaccaagcaagcaacaagaaacaugcagauggucuggugugauacacucagaucaaugaccgaagguacacgaugugcuauccuuucugcaugggcucuuacuauucgcggcuacaccagcucccgugauauuguuuuuggggaguugcugucagaaguugaauuggccuccacugagcgucaggacaauuauacgcaagcugcaacuaucguuccccgacgcuuccaacucaacgaugauuggaccguuacugagcuacugagcagggugaagaaccaacuggagucagcuaagcccuaccaaugggcuggaauaagucaaauucagaaauugaacgcugauacggcgcgcgccugugauuucaugaacuugaucucuauaacggacaaucguggccuugaaccaagucuaguacccaugaaacagcaugacagcaaucuguccgguuauccuuugaugguugauuguauccuuggagaugcuacgcucgaacucuugauuaguuacgaugacagcacuuuaacaggcacccagaucgagcgacuggcugcccaauucuucgcuuguguuggacuucuuaacuccaaggcuagcaugagcaagacaauugguaucuuguccagagacaacauggacuuuugcuccuuccgccaugauguugccuacuggaaaaacuacuuggaggauguugaagcuugucuuuucccggcacuacgugcacgugcggaggaaaauacucaugcugagacucagauaauacuccagaacaccaagcaucuacaugaucucagugaacgugaacgucucagcaaaagcucacuucuucagcuuguuuggggcuugguucugcgaugcuacacaggccuacaagaugugugcuucggauaucacauuucagaugcaagcgacagaucugccaagccuggaguugcgaauaagccagauauuucagguacauucccgugcagaaugcucuugaauggugaaucuaggguugcggaaauuuugagagagcgacugcaaggacugaaucaaaugcagcagcaucgguugccgugggaugaaguccagcaagagcuuggguguagcgacauuuucaauaccguuuucacuuguucagaacaaucaagugacgcaguaaauguggcuggucucgcugaucuugauccgagcaaauaccugauuaccgucaacgccacucuagcagaaucaucaggagucauuagguucggcuaucaaaggaggcacuucucagaaaccgacauggaaggcguccuugauuguuuuaauaauauucugggacaguuacuccaauuuccucuuccggaucuuuugguaggcgagguugacuuugugagugagcuuuccugccagaagauaucugaguggaacucggcgcugccagaccguccagugcuaugcgcgcaugagcucauccaacagcaagccuuggaucgugcuacggcuccugcaauuuguucuugggauggcaacuucacauaugcacaacuugaccgauugucgacucuccuagcaaaccagcuggugggcuuaggggucaagcccgacaucuuuguugcauuguguuucgaaaaguccgcaugggcaguuguugcacagguugcuguuuugaaagcuggaggagccuucgcuucauuagauccagcucacccagaaagccgccuacaaggcaugaucgaugaucuuggcgcucagguuauucucuguucugagacacacuacgagagagccuccagcaucugucgucgcgcaaugaucguaagcaauagcgcacuugaacaacuuuaccacucacccuuugcugcuccgacccaagagguaaccgcugauaacgcagccuacgccauauucacaucgggaaccacagggaaacccaaggugacaguacuugagcauguuggacuuacccuagccugcacagagcucuccagggccuucuucauaaguucagaaacacgcgcucugcaguucucaagcuauacauucgacgucagcauauuggaaacuaucauaguccuugcugcuggugguugcauuuguaucccuagcgaagaugagcgcaugaacaaucuuucuggagccaucagaaagaugaacgucaacuucaugagcuguacuccaucuaucguuaauaccauggaccccaaugcuguuccuucauugcgaacaauaacucucggaggagaaaaaaugacugcaagccauuucgagcgaugggcugacagguguguuauuaacgcguacgguccgucagaggcuacugucgccuuuacgucaagcacaaaauacgaccaugcaggaguacgccuuacugaugacuaugguucuauuggcacugcuauuuguggcaggacauggauuguugauccccaaaaucacaaucgacuugugcccaucggcgcacccggagagcucguucuugagaguugcacuguugcucguggguaucucaauaaugacgggaaaaccaaggcuguuuucauccgggacccggaguggacucagcgugaagggcuacagcauguguugaggcgcaaagaacggauguaucgcacgggagauuuagugcgcuacaacuccgacggcucgauugcuuucauuucgcgaauugauacacaagugaaauugaacggugugcgcaucgaauuggaagaaguugagcaacaaugcaacaacuaucuuucgacagauacucagguugccguugagguuguuacuccagaggccaaaacuauaucaaaaugcuuggcugucuucuucaccauugacgagcaccaaaugaaagauauggcgaauggugaauucauucugcccaugucagagucuguaguucacauggucaagaagcuacacgguucccuaagcgcuucauuaccgcuagcuauggugcccaagcuuuacuuccccaugcggcgccugccguuuggaagcacuggcaaaacugaucgcaaagcacuucgagcaauggucgauacauuuaccaaggaacgcuugagaccauauguuaucuucaauguuggcacagaagaacgcuccgaugugggaacggaagggacagagggcguucucaagacgcuaugggaggaaguccuuaaccuugcgccagguucuaucagugccgaagacaacuucuucggcauggguggcgacucguuuucugcuaugaaacuagucguagccgcggcaucccagaauauuucacuugcaguggccgacauauaccgaacuccuauauucaaagacauggcaaagacauguggagcgggugagguacagacuggcguaccaacaguggacccuuucagcaugcugccugaaucucuuucacgcgaugauauucuggaggaagucucugaucaauguggugugccuauggaucgaauugcggacaucuacccuuguaguccggugcaagagggcuugcucacacuuucuaucaaacaacccggagccuaugucgcucgaccuguguuccaacucgcagagggagcugaccuugacaaguuuaaagcugcauggcaaaaggugguuaaugaaauggauauucuucggacucggguaguacacaccgaguccgccaacuuuguccaggcagugcucacugaugucccuauccucugggaaacggcaacggaauuggaugauuuagcaaacgacacuauugaccuagccaagaauaacgggggcuugcuaacuggauacgccauugucgaguccggacacucgcgcuccuucguuuggaccauacaccacgcucucuaugauggauggagugugucccagauccuucaacgaguugaggagauauacucgggugcuucaaaacuuagcucgacgcuuccuuacaagcucuuuaucaaucaccugguccagcaagaggcucauuccucggacgaauucuggaagacacaccucgcggcccugucuucauguccuuucccccagaacaagccgucaccugauaccauucgcgucggcaaucggcauuacagcucgcuugagauuucucaugcaccaagugggccuaauuuaaccguuccugaaaugauacgagcugcaugggcacuaauuguauccguccacaccgguuccggagaugucugcuucgcugaaacccuaauggguagaaauauugauaugccuggggcuauggaaguugcaggaccucuuuugacaacgguuccuauacggauggcugucaacaacgagcucucgauuauucaguaccucgauaaugugcgccagcugaccacaaugaugcugccgcaucaacauucugggcuccagaggauucgcaagcuaagcagcgacacugcccuugcuugcgaaucccaaaaucuacugguuauucaaucagaacaggcccauucgaacacaaguaucugggagcaaaaggauaaccugacugaaggcgaauuuuucacccacccaauuguugucgaaugcaagguuggcgaaucgcagguggccguaacccuucaucacgacgagcuuguuuucgacaguuggcaggcuaagaugcucauugaacaguuuaccuucguuuugagucaacuguuaucaaucuccaaugaagaauccagaaagaucggagagcuagagguuuccaguucucgggauaaggaagaaauugcucucuggaaugagagaaaccugacuugcauagacagauguguucaucauaucauugaggagaaagcaucccuccgaccucaagcucaagccgucugcuccugggauggacaacuaacuuaccaggagcuuuaccagcuugcuucuucguuugcagcuuaccugaaaacucguggcgucgguccggagacuuugguuccgaucuguauggacaagucuuugugggccauugucacaauacuggguguccucauugcggguggaggauaugucccccuugacccugcucacccaacgucaaggcacaaggagauucugacagaagucgaagcccgugucguucucuguucucccaaguaucaaagucgguacacuggcucugugaaagcaaucaucccugucagcaaagagacaaucaaggcguauugugcucuuaaaacggcaaccgcuaagacuacuaacaacgcuacacccgaaaacguugcauucgcuaucuuuaccucuggcagcacuggucgugcuaaggguauuaucaucaaccacaaggcacuugccagcagcggcauggcauucgggcccauggugcaccuugacgagaauucucgagcuuuccaauuugccucucuuacuuuugaugcugcugucauggaaacacucgucaccuugaugcacggcgguugcgugugcauuccaagcgaagaugaacgcuugaaugauguugcuggcgcuauucgucggaugaaugucucuuggucauuccugacuccauccauagccaguaucauugaaccgucauccguuccaucucugagggaucuugugugugguggagagaagaugucucgcgaagucaucaccaaaugggcacaucggguaaaccugaugaauggauaugguccaacugaaacuacuaucuucgcgguuaucaacacagauguugcugccaauccggaucccgccuguaucggccauggcauuccuugcacccuaaccuggguugucgauccugacgaccacaacaaacuaacuccucuaggggcuguuggugagcuggcacuggaaggccccgcacuugcuagggaauaccucaagaacccuaagaagacagcagaggcuuuuguggaugagccggaguggauuaaggccuucccuaguguccuaccuucgcccagaagaauauacaagacuggagaucuugucagauacaacucugacgguuccauucaauacaucagccgcaaggaccaucaagucaagcuucacgggcagcgcauggagcuuggagagauugagcacagacuauaugaggacccgcgaguccgccacgcuguggucuuacugccaacggcagguccccucaaacagcgguuggucacuguucuuucacugaauucuguaacugcggagaaaagcaucauaucagacaaugcaugugaacuugucgaucgggguggaucugcacgggcagcauaccaggagcucguugcuauccagaagagcuuagagacacagcuaccaaucuacaugguuccacaggcuugggcucugaucaagcagcucccaaugcucgugucuggcaagcuagacaggaagcgaaucacagcuuggcuggagaacguugaugaugcugcuuaugaucgcauaauggaggauuacgacaacauaaaacguggggaugucgagcaagacgaggagaaagaggaugaccgagagacuucugucaagcuucuucaggaagucuuuucccagguucucaacuuaccaucucacaaggugggcuugaacaggucauuugugagccuagguggugauaguaucacuggaauggcugucauuucucgagcgcguaaacauggacucacgcugacccuccacaaugugcuucagucgaagucgauaaaggagcuuucucuagcugcucagacaagcgucaagacagugaaaagagaggagaagccucaugaauacuucgaacugucuccgauccagggauuguucguucaaacaacaacaaauuuucgggauucuucucgcuuuaaccaaagcaugacaguucgcguuacucgaagggucgagccaacuagaaugcaacgcgccaucaaggcuguuguugaacagcacuccauguuccgagcacgguuguucaagucucgcgacggaaaguggaagcagaagaucagugaugauguugaugccucauaccgcuuccgucaucauaugguggaaaauaaagaugcaauucuccccaagaucgccgagugucaacggucuguagaugcucaacauggacccaucguugcugcagacauguuccaagacauccaagauuuccucgaugcuggaucauuguccccggagaagccccugucauuccaagcuuggugcaaccuucagcuugaacagagcaagaaaccaaauggcagaguccagcugccuuuuucuauucagccucccgaccugaaauacuggggcauggagcagucccagaaucucuauggggaugucaagauggaaggguucacgcuugaugccgcagucacgacacaaauccucgcagccugcaauaagguucuacgcaccgaggcuauugaagucauacucuccgcuguuauucacucuuuccgucgcacguuuacugauagagaaaugccgacuauuuacaacgagggccacggucgcgaggcgugggacagcucuaucgaucucucaagaacggugggcugguucacgacuauguguccacugcauguuggugaagggucggaucuacuugacacuuugaagcgugucaaagacacaaggcgucaccucagcaguaagagccggucauacuuugcggaaagccugcuucagccggaagguaaagagggcgaugcuuucucugucccgcucgagauucuguucaacuaccuuggccagcugcaacagcuagagcgcgaugauucgcuuuuccaacauuauggugaagccuucaacgcggagaccuucgagaugacaggggacaugggcucgaagacaccucgguuugcucucuucgagaucucggcgcuuauaaucaagaacaagcuucagguaucguucacuuacaauaagcacaugcagaaagaacagcggaucaagggcuggauaucugaguguaaacgagugcuggagcauaugucucguuucgagagcuucacaucugagccgacacucagcgauugucccuuacuccccaucacuuacgaaggccugaacaacauggucaagagagcauucccaaagauuggaauugauagcugggaucagguugaggagguuuaucccugcuccccaguacaagaagguauccuucuuagucagcuucgagacccggaggaauaccuguuccaugucaucuuugaagugcacccauccaaggguagcaagguggauacaagcaagcuucgaaaggcaugguccaugguugucagcaggcacccuaucuuacggucugucuucauugacagcaacuacaaaggcggaucuuucgaccagguaguggucaagucacucgacgaugaggucauugaguuccagugcccugagucggaugcauuggguacacuuggggaaauaaagcugcgcgauaucaaugcugagagaucgaugaagcucgcccaccagaugacccucugcaaaacaacuucugggcgaguccuguucaagauugagaugaaccaugccauuaucgauggcgggucgguugaucugcuucuucgggaucucgcccucgcauacagugaucagcuuucugccggaaccgguccacguuuuagugauuaugucaaguauaucagggaacaaucccagggagaagcaguggcacacugggugaaguaucuuucuggcgugcgaccuugucaccuccugguaucuuccaaaaagagcgguagccaccagcucggcgagcgcaugauaucuuucaagcgcuucucugaguugcaaagauucugcgaggaaaauuccgucacacucgcuaacuugacccucugugccugggcaauuguacuccggaauuguacaggaucugaugaugucugcuucggauauccgucugcuggucgugacuccccuguuccugggauccaagaugcggucgguaucuucaucaacauguugugcuguagagucaaauucucucccggacaaacucuucuugagauugccaagaagguacaggaugacuuugucaggaaugugccgcaucaacacugcucucuggcucagauccagcaugagcuuggaaugcauggagagacgcucuucaacucaacucuuuccauucagaaucgcucugccaacaaaggcacuagaaauuugccgcucgacuucgaagcccaaaaggcccaugacccgacugaguauccuguuacuguaaauguggagacuaccaagggcaaggagggaguuuugcugagguacuggagcaacgcagugaccgaagcacaagcaaaggagcuagcggaagcuguuaacaaggucuuuacaugcuucaucgaggagccauccaagcugguaucgagcuugaaccuccuuaacaagcuaccgcggaaccguucgcagcacacgcacagggagccccuuauuuuggaccaguugauugacagucagguccuacagaagcuaauugacgaucgcgugaaugagauaaucagccaaaugcugaaggaaggcaagcucgccauaccccuuccugaucagaagacuagauacucgaacagcucuguucaacucaagauggucgaggcuucgcuccaggaggaucccauaauagacgaaaaggaucuugcaaacucaacaccaucccuaacagaugauggcagaagcucaagugacaaugauaggcgccuuugggaccuguggaagucgacauuagggcuaucuucagacacuauccaauaccggaguagcuuuuucaagcuaggcggugauaguauuacagcaaugaagauggucagcgcugcacgagaagagggcuugcaaaugacaguggcggauguguucaacaacccgaucuucgaggacaugcuggcuacgauuacuccgagcagcagcccgaccucaaacgccgauacccagugcgcaaacaacauugaaaaacuccuggagguuaaugaugcccuuccagaugcuaccccaccgcaggauaucucggugcuuaggccaaugcagcucgaugccaugucucugcuugaugucaucugcccuaagauagggguguucaaaggaggaauugcugauguucucccuguuacggacuuccaauccaugucgaucgcugccacgcucuucggaucgagguggaugcugaacuauuucuuccucgauggaagugguccucuagaccuucgacgacugagggaaagcuucuugaggguggucgaugcuuucgauauccuucgaacuguuuuugucugccaccacgggcaguucuuccagguggugcugagaaaaguccgaccggacauuuuugugcaugagacggagcagagucuagaugaguacaccaacagcuuacaaaaacgggaccgcgaacaagauccacgccaaggugagcaguaugugcaguucuacguugucaagaauaagaauagcgaccagcaucgcaucuugaucaggaugucgcaugcccaauucgacggcguuugucugccaaagauuaugaacgcaaucaagcugggauacgagggcagcacccuaccuccagucuucuccuuuucgaacuauaugcggaugcuuccuggaaacaucaccccggcacacuaccaccacuggucaacaauacucaagggcucuaagaug

SEQ ID NO: 22 - protein, 5852 aa, Aspergillus niger
MAQPVSCCLPKFGTSTHGPRRPASLRIRTSPSQTLQLLAAWDQSELDSLLKATWALLLHRYTGLEDICFGYQPIGVDAGPRDTVTSSDTHNNIPLTFNLTITEDDSVHAILRNTKKQNEAEKCGSSSSSCHSYTLCNTLLMLRNCRSVTKDPRAPLVQPALAIPLPEKCRVRLHVKVLQKDVGIFFEWWNNDMSTEHMKSVADYFEQILSRVLSAEDTAARDLNHFSDRDWSRVCNFNSTIPQAHDRCIHEVIHEQVLARPGSEAVCAWDGSLTYQDLDLLSSQVAYHLQAHGVGPEKCVALCFNKSKWNVVAMLGVLKAGGAFVPLDPTHPTSRLQSLVHAVQAKVMLCSRDRIGELTGVAEMIIPLDQAIIDEISLQAEEIYSLPDVQGHNAAYVIFTSGSTGEPKGTMLEHRAYVSGAAAHAGPHHMFSTSRVLQFAAHTFDASLVEILTTLLQGGCVCIPSEEERLSDIVKVINEMNINHAILTPSFVEFIDSSQVPGLETLILAGEAMSQGQLETWSSALHLINAYGPTESSVAAVVNAKVTPSSDCRDIGLPVGVRCWVVDPSNHDQLVPVGCPGELLLEGPTLARCYLNNPQKTSEAFIHDPAWMRRDGLNDCNRRVYKTGDLVRYNSDCGSLTYIGRKDTQVKFHGQRLELGEIENQLAADPIVKHCLAFLSKSGFSAGKLVAVISLSVHFESQPESNAAPLKLLDTSKKTSIVAEVRERLSAKLPTYMIPSVWLCVEALPLLPSGKLDRKATARWIGDMERDPYAQAISARTLSADKATLPSSATEDKLAAIWSRVLNIPRSQLALDEGFLSLGGDSIAAITCLGYCKKQGMGLTVQEVLHSKSIKELATRVKQIDQFVVYEEKIDEPFDLSPIQKLHFMVRNEGQGHFNQSILTRLNRHIDEHSMRRAIETIINRHSMLRSRLVESDVEGIMRQRITQDVAGSYRWRSHNNSNRSEVDHAISNSQSCINAFVGPVLAIDVFYGNDHSRLLSLVAHHMVVDIVSWRIILEDLEDLLMNPDQPISQNGSLPFQNWCQIQADRCQEATAERTMDLPEVPAPDFAYWGLKSHQTTYGDVDCETFDLDSDITRHILTGCHESLQTEPIDLFLAALLHSFGETFKDRSLPVIYNEGHGREVWDSSIDISRTIGWFTTLYPILLSELPAKDPTETVVRVKDLRRCVPDNGRHDFARRMLVPREDGTCRHYSPMEMSFNYVGQHRDLQRKDGLFQLMDQMAGETGRGGAAADFGEETPRFALFEISAMVVQGQLRFIFSFNRNMQHQNGIRNWVHCCKTLLASLGERLQALPPKPTLSSFPMLTLTYTELDALVSKKLPDAGIHSLDDVEDIYPCSRMQQGILLSRSRDSSLYAVHDTFEISGPGSTPDINRLILAWQKVVAHHAMLRTIFLEGLSSHDLHCQVVLKSFDSRPTYVVCANESEVLPTFDKQQPMSYDNSIPPHRLTICQTASGKLFCRLELNHVAMDGASISIILRDLQLAYQGKLEEPKPKFKEYIRYLREVPQVASLDYWRNYLLDVQPCHFPVLNDGKGSVRQLRTKRLGGVPFKELRTICDMNGLTLPTAFSAAWGLTVRSFCGSDDISFTYLASLRDVPVEGVEYVVGPVINTLTCRMLFAKGTSLKEILAKVQQDNLDNLPHRHISLTEIQQALGLTASLANSGISYRKLPNQNALSSEEIQFSEVGTIHDPAESPVFVNVEATEDDARIDLNYWTDHLSDGQAENVASTFLKSVENIVHHFEDDAHSIDNFSDANRQSLMLWNSEVPKSIDKCMHEIVDECAKSHPHTMAISAWDGNLTYAKLNELSSLLATYLTTLGVGPGTIVPLDLARSSWQVVAILAVMKTGGVCVPVNPARLPQHFETWLVDNEIQVALASPTQMQLLEGAVPYVISVESSLFEYLSDSDAVSSSPIQPCSDAYIVFGAESPKCILIDHRAITTRASAFASGLGLNARTKMLQYAPYTSDMFLQEVFGTFLCGGSICIPSDEDLADLSKAIKTMQANCVSITPSMAMTLRFAEDLGIKVLALWGEHPTKQLLTALPGGIQVHAFYGTPECSSSCIRSSQLDGSCESSIIGSSLGCKSWLVDPSDHDILVPIGCVGELMIEGPSLSHGYYQDAELTQQYFVENPFWRLAYESQPSSDKDKNTDAQKLSYRLFKTGDLARYNSDGTLVYVGKKDRGLHWQRQTAAIYVEEQIASLSSFNAQYVVEEISKRNVDSPRSSLAIFFSDEAVDSKGHHQPIAQLSPELHDSMIRLYKKLSSSLPANSVPRLYFPTSSIPLNSFGKLDRQLLRNAAQNLPEGLLSRFDIKSFDSFWKGQLATLAVSPVFPPPRGSLSQPSTPVTKQATRNMQMVWCDTLRSMTEGTRCAILSAWALTIRGYTSSRDIVFGELLSEVELASTERQDNYTQAATIVPRRFQLNDDWTVTELLSRVKNQLESAKPYQWAGISQIQKLNADTARACDFMNLISITDNRGLEPSLVPMKQHDSNLSGYPLMVDCILGDATLELLISYDDSTLTGTQIERLAAQFFACVGLLNSKASMSKTIGILSRDNMDFCSFRHDVAYWKNYLEDVEACLFPALRARAEENTHAETQIILQNTKHLHDLSERERLSKSSLLQLVWGLVLRCYTGLQDVCFGYHISDASDRSAKPGVANKPDISGTFPCRMLLNGESRVAEILRERLQGLNQMQQHRLPWDEVQQELGCSDIFNTVFTCSEQSSDAVNVAGLADLDPSKYLITVNATLAESSGVIRFGYQRRHFSETDMEGVLDCFNNILGQLLQFPLPDLLVGEVDFVSELSCQKISEWNSALPDRPVLCAHELIQQQALDRATAPAICSWDGNFTYAQLDRLSTLLANQLVGLGVKPDIFVALCFEKSAWAVVAQVAVLKAGGAFASLDPAHPESRLQGMIDDLGAQVILCSETHYERASSICRRAMIVSNSALEQLYHSPFAAPTQEVTADNAAYAIFTSGTTGKPKVTVLEHVGLTLACTELSRAFFISSETRALQFSSYTFDVSILETIIVLAAGGCICIPSEDERMNNLSGAIRKMNVNFMSCTPSIVNTMDPNAVPSLRTITLGGEKMTASHFERWADRCVINAYGPSEATVAFTSSTKYDHAGVRLTDDYGSIGTAICGRTWIVDPQNHNRLVPIGAPGELVLESCTVARGYLNNDGKTKAVFIRDPEWTQREGLQHVLRRKERMYRTGDLVRYNSDGSIAFISRIDTQVKLNGVRIELEEVEQQCNNYLSTDTQVAVEVVTPEAKTISKCLAVFFTIDEHQMKDMANGEFILPMSESVVHMVKKLHGSLSASLPLAMVPKLYFPMRRLPFGSTGKTDRKALRAMVDTFTKERLRPYVIFNVGTEERSDVGTEGTEGVLKTLWEEVLNLAPGSISAEDNFFGMGGDSFSAMKLVVAAASQNISLAVADIYRTPIFKDMAKTCGAGEVQTGVPTVDPFSMLPESLSRDDILEEVSDQCGVPMDRIADIYPCSPVQEGLLTLSIKQPGAYVARPVFQLAEGADLDKFKAAWQKVVNEMDILRTRVVHTESANFVQAVLTDVPILWETATELDDLANDTIDLAKNNGGLLTGYAIVESGHSRSFVWTIHHALYDGWSVSQILQRVEEIYSGASKLSSTLPYKLFINHLVQQEAHSSDEFWKTHLAALSSCPFPQNKPSPDTIRVGNRHYSSLEISHAPSGPNLTVPEMIRAAWALIVSVHTGSGDVCFAETLMGRNIDMPGAMEVAGPLLTTVPIRMAVNNELSIIQYLDNVRQLTTMMLPHQHSGLQRIRKLSSDTALACESQNLLVIQSEQAHSNTSIWEQKDNLTEGEFFTHPIVVECKVGESQVAVTLHHDELVFDSWQAKMLIEQFTFVLSQLLSISNEESRKIGELEVSSSRDKEEIALWNERNLTCIDRCVHHIIEEKASLRPQAQAVCSWDGQLTYQELYQLASSFAAYLKTRGVGPETLVPICMDKSLWAIVTILGVLIAGGGYVPLDPAHPTSRHKEILTEVEARVVLCSPKYQSRYTGSVKAIIPVSKETIKAYCALKTATAKTTNNATPENVAFAIFTSGSTGRAKGIIINHKALASSGMAFGPMVHLDENSRAFQFASLTFDAAVMETLVTLMHGGCVCIPSEDERLNDVAGAIRRMNVSWSFLTPSIASIIEPSSVPSLRDLVCGGEKMSREVITKWAHRVNLMNGYGPTETTIFAVINTDVAANPDPACIGHGIPCTLTWVVDPDDHNKLTPLGAVGELALEGPALAREYLKNPKKTAEAFVDEPEWIKAFPSVLPSPRRIYKTGDLVRYNSDGSIQYISRKDHQVKLHGQRMELGEIEHRLYEDPRVRHAVVLLPTAGPLKQRLVTVLSLNSVTAEKSIISDNACELVDRGGSARAAYQELVAIQKSLETQLPIYMVPQAWALIKQLPMLVSGKLDRKRITAWLENVDDAAYDRIMEDYDNIKRGDVEQDEEKEDDRETSVKLLQEVFSQVLNLPSHKVGLNRSFVSLGGDSITGMAVISRARKHGLTLTLHNVLQSKSIKELSLAAQTSVKTVKREEKPHEYFELSPIQGLFVQTTTNFRDSSRFNQSMTVRVTRRVEPTRMQRAIKAVVEQHSMFRARLFKSRDGKWKQKISDDVDASYRFRHHMVENKDAILPKIAECQRSVDAQHGPIVAADMFQDIQDFLDAGSLSPEKPLSFQAWCNLQLEQSKKPNGRVQLPFSIQPPDLKYWGMEQSQNLYGDVKMEGFTLDAAVTTQILAACNKVLRTEAIEVILSAVIHSFRRTFTDREMPTIYNEGHGREAWDSSIDLSRTVGWFTTMCPLHVGEGSDLLDTLKRVKDTRRHLSSKSRSYFAESLLQPEGKEGDAFSVPLEILFNYLGQLQQLERDDSLFQHYGEAFNAETFEMTGDMGSKTPRFALFEISALIIKNKLQVSFTYNKHMQKEQRIKGWISECKRVLEHMSRFESFTSEPTLSDCPLLPITYEGLNNMVKRAFPKIGIDSWDQVEEVYPCSPVQEGILLSQLRDPEEYLFHVIFEVHPSKGSKVDTSKLRKAWSMVVSRHPILRSVFIDSNYKGGSFDQVVVKSLDDEVIEFQCPESDALGTLGEIKLRDINAERSMKLAHQMTLCKTTSGRVLFKIEMNHAIIDGGSVDLLLRDLALAYSDQLSAGTGPRFSDYVKYIREQSQGEAVAHWVKYLSGVRPCHLLVSSKKSGSHQLGERMISFKRFSELQRFCEENSVTLANLTLCAWAIVLRNCTGSDDVCFGYPSAGRDSPVPGIQDAVGIFINMLCCRVKFSPGQTLLEIAKKVQDDFVRNVPHQHCSLAQIQHELGMHGETLFNSTLSIQNRSANKGTRNLPLDFEAQKAHDPTEYPVTVNVETTKGKEGVLLRYWSNAVTEAQAKELAEAVNKVFTCFIEEPSKLVSSLNLLNKLPRNRSQHTHREPLILDQLIDSQVLQKLIDDRVNEIISQMLKEGKLAIPLPDQKTRYSNSSVQLKMVEASLQEDPIIDEKDLANSTPSLTDDGRSSSDNDRRLWDLWKSTLGLSSDTIQYRSSFFKLGGDSITAMKMVSAAREEGLQMTVADVFNNPIFEDMLATITPSSSPTSNADTQCANNIEKLLEVNDALPDATPPQDISVLRPMQLDAMSLLDVICPKIGVFKGGIADVLPVTDFQSMSIAATLFGSRWMLNYFFLDGSGPLDLRRLRESFLRVVDAFDILRTVFVCHHGQFFQVVLRKVRPDIFVHETEQSLDEYTNSLQKRDREQDPRQGEQYVQFYVVKNKNSDQHRILIRMSHAQFDGVCLPKIMNAIKLGYEGSTLPPVFSFSNYMRMLPGNITPAHYHHWSTILKGSKM

SEQ ID NO: 23 - protein, 4 aa, Aspergillus niger
  PEPTIDE (1)..(4): Cyclic tetrapeptide
VVWY

SEQ ID NO: 24 - protein, 4 aa, Aspergillus niger
  PEPTIDE (1)..(4): Cyclic tetrapeptide
VLYW

SEQ ID NO: 25 - protein, 4 aa, Aspergillus niger
  PEPTIDE (1)..(4): Cyclic tetrapeptide
VLFY

SEQ ID NO: 26 - protein, 4 aa, Aspergillus niger
  PEPTIDE (1)..(4): Cyclic tetrapeptide
LLFY

SEQ ID NO: 27 - protein, 4 aa, Aspergillus niger
  PEPTIDE (1)..(4): Cyclic tetrapeptide
VVFW

SEQ ID NO: 28 - protein, 4 aa, Aspergillus niger
  PEPTIDE (1)..(4): Cyclic tetrapeptide
VLFF

SEQ ID NO: 29 - DNA, 1816 bp, Artificial Sequence
  codon optimized sequence
atgaagtccactattatcacctccattctcttctctgtggctgccgtccaggcctatagcccggccgagcagatcgacgtccagtctcacctgctttctgaccccaccaaggtcgagggagagacttacgactatgtcattgctggtggtggtttgactggtctgaccgtggctgccaagctgtctgaaaacccgaagatcaaagtccttgtgattgagaagggattctacgaatccaacgatggaccgatcatcgaggaccccaacgcctatggggagatctttggaactagtgtggatcagaattatctcacagttcccctcatcaacaaccgaactggggaaattaagtctggcctcggtcttggtggctcgaccttgatcaacggcgattcctggacccgccccgacaaggtccagatcgactcatgggaaaaggtctttggcatggagggctggaactgggacaatgtcttccagtacatgcagaaagctgagcgctcgcgccccccgactgccgcccagattgaagccggtcacttctacgaccctgcctgtcatggaacagacggaaccgttcatgccggccctcgcgacaacggcaagccttggtccccactgatgcgagccctcatgaacaccgtctccgctttcggtgtccccgtccagaaggacttccactgcggtcacccccgtggtgtctcgatgatcccgaacaacctccatgagaaccagatccgggctgatgccgctcgcgaatggcttcttcccaactaccagcgcgataacctgcagatcctgactggccagaaggtcggaaaggttttgttcaaccagaccgcatctggacctaaggctgttggtgtgaacttcggtaccaacaaggctgttaacttcaatgtctacgccaagcaagaagttctgttggccgccggatctgccatttctcctttgatccttgaatactccggtattggtatcaagtccgtccttgacaaggccggtgttaagcagctcctcgaactccctgttggtctcaacatgcaagaccagaccactaccactgttcggtcccgcgccaacaacgcacctggacaaggccaggccgcttactttgccaacttcaccgaggttctcggcgaccacgccgcccagggtattaagttgctggacaccaagcttgaccagtgggccgaggagaccgttgcccgcggtggcttccacaatgtgactgccctcaagatccagtatgagaactaccgtaactggctccttgatgaggacgttgcatttgccgagctcttcttcgacactgagggcaagatcaactttgatatctggaatcttatccccttcactcgcggttccgtccacatcctcagcagtgacccttacctctggcaatacgcaaatgaccccaagttcttcatgaacgagctggatcttctcggccaggccgctgctactaagctgggtcgtgagctctctagcgctggtgagatgaagaagtactacgctggcgagaccatccccggcgacaacctgccccaggatgccaccgtcgagcagtgggaggactacgtgatgatgaacttccgtcctaactggcacgctgttagcacctgctctatgatgtcccgcgagcttggtggtgtcgtcgacgctactgccaaggtctacggtactcagggcctccgtgtcattgacggatctatccctcccactcaggtgtcctctcacgttatgaccgttttctacggtatggccttgcggatcgccgaatccgtccttgaagactatgccaagaaagcttaaa

SEQ ID NO: 30 - protein, 604 aa, Penicillium chrysogenum
MKSTIITSILFSVAAVQAYSPAEQIDVQSHLLSDPTKVEGETYDYVIAGGGLTGLTVAAKLSENPKIKVLVIEKGFYESNDGPIIEDPNAYGEIFGTSVDQNYLTVPLINNRTGEIKSGLGLGGSTLINGDSWTRPDKVQIDSWEKVFGMEGWNWDNVFQYMQKAERSRPPTAAQIEAGHFYDPACHGTDGTVHAGPRDNGKPWSPLMRALMNTVSAFGVPVQKDFHCGHPRGVSMIPNNLHENQIRADAAREWLLPNYQRDNLQILTGQKVGKVLFNQTASGPKAVGVNFGTNKAVNFNVYAKQEVLLAAGSAISPLILEYSGIGIKSVLDKAGVKQLLELPVGLNMQDQTTTTVRSRANNAPGQGQAAYFANFTEVLGDHAAQGIKLLDTKLDQWAEETVARGGFHNVTALKIQYENYRNWLLDEDVAFAELFFDTEGKINFDIWNLIPFTRGSVHILSSDPYLWQYANDPKFFMNELDLLGQAAATKLGRELSSAGEMKKYYAGETIPGDNLPQDATVEQWEDYVMMNFRPNWHAVSTCSMMSRELGGVVDATAKVYGTQGLRVIDGSIPPTQVSSHVMTVFYGMALRIAESVLEDYAKKA

SEQ ID NO: 31 - DNA, 22535 bp, Penicillium chrysogenum
ctcccctataggtacatcgtacatgcacttcgcttggcttgactagtgagaatagtgggaattacaaatgtacgttccagatcctgcttatacaaaattccaagaagacaaaaataactcaaaaaaaaaaaaaaaaaaaaaaaaaagaaaagaaaaagaaaagaaaagaaaagaaaagaaaacgtgaggaagcaggaaaaagcaattatgccgacactacatgagtccatgtttttgatgcaactggcccatgaccggaaggactgtacggagtactccgtacaaaatgagatcttttgtttccccttttcgcttgaattcagatccatattctcgttcacatggattgagctattgattcattgaagttattgtggatgttactataaaaatacactgaacgccaagtcgacaggtctccggatagtgccatcccttggaggcccttgcagaaatcattagtcgcatatactttgtcttacacatcaggtaatagttagttacatcaattccctcttgtaaatttttataaacgaactcaaatttcattttgagatccaatcgccggccatgccctaccagatctaatagtatttcacttttagccaagtattcctccgatgctagtcatacctacccctgtaatatattcggatccatacaatgggagatccgaagtacgaagggcgtgataacctcagctcgggtatcaaacccaacaatcagctttggtcttttgcttgactcctgaacctccaaaaactcaccacatccaagacacgatcatgtcagatcagatcccggcagattaactttcccatctcgatcaccggacaggatcgacatttccactacaccctcactgcggtagtgcctgaactgcgcggtaaatcctcgttcgtcccgtcctagctcgccacaccttactgatgcaggaccccagttctcgggttgccatgccatgcgttcccatcaccagagcttccagactagaggtgagcgtggagcaactaatccggggtcagtgccatgtgcgcatccggcggtgtacatcgtaacctataaccgccgcacgaggctcgtatatcatctgtggcgatgccatgcatcgagccaaagcctatacccgcagtatgaagtgagggcataggctctctcccatttgagaatatgtacctgttcgcccagctcgctctaaccgagctcgacatgggacagcgaagcagacagcagtgtcagcattgcaacctcgtaagcttcaggggaaagtgaaactgtagatggtagcgccacccaatatgaacaagattccgggtcaaacgcctcatgtccctgaaggctctgaactactattcccacgttccagaccgcaagggttcctgatcgggggaattgctcccagttggaagaatagtactccggtgtaccgagtacagagagacagagggagagacctttcccctgcatgatgacctgtttgtattagttcgagtgaggtactttcccaagggttaccttggcagttcaaaatagaaaatacgaaattcgacacggcaactcgggaaaaaaaaaatagaaaaaagaaaagaaaaaagaaaagcagagaagagtgtctgacttggttccacaggggggccaagtacacacctgatccacgtattgtctctcgccctctcccttccatctagatcccatgcaaggaatatggcgtctattactggattctggagagaggtgtggcccatgcagcccccggcggaggtggctattttcgattgtaagggtaatcatacgtattttccaggaatagaaaaaaatacttgtacttagttctttaaaataagacgagaccgtccgagttcgcgggcgcacttgaaccaccgtcgaattaatactgtcgttcatccttcgtaccttaggcccacacatacacatcctctccatcgaccgaacacgaaacgaaacatagacggcttggtactatccagccattagacatcatggctcaatccaccaagtgctatcttcctcggttcgcttcgacggttgacgggcctaaacgcccagtctcgatgaagacgagacccacggctgctcagcatgcgcagttattaaccgcatggaacgaaggccgtctggaccccatcctacgagccacctgggctctcttgttgcactactatatccgctccgaggatatatgcttcggttaccaacatctcgagggcgactcgcgctctcccaaatcatctgtacagcgttctaccgtcaacatttcgacgatccgcatatccatcaacgacaacgactctctcaaagcaattgtagataaggtgcgcgcaaacagtgcgattcgccagaacaatggaagccccgaggcttccgaggcatatcttcctttcaacaccatcttcatgctgcgcacatacgacccgcctgcttctccttcaaaacctattctggcgacagctattccggacgaggtgagtttgccccgcaagctggcgacgggggtctcctgtagacaagaacggcgttgggctaacaatgcgcagtgtcaagtccgtcttcatgtcaaggtgctgcgtggagacatcagcatcttcctcgaatggcgcaagggtgacatgtccggggaacagatgaagagtatcgcaaacatttttgagcagttgcttgccaaagtgctttctgccgagaacaccgctattagccagcttaatttgttctcggagaacgactggcaacgcatccgcaagtggaattccactactccacagcttcacgatcgctgcattcacgaggccatccacgatcaaatgttgagcggacctgatcgtgaggctgtgtgtgcgtgggatggaagtttgacgttcgccgagttggatcaccaagcgtcgaagcttgcatgctatcttcgcatgcagggagtcgggccggaaatccgcgtggctttgtgttttgataaatcggttagtcgcatgttccatgaatggtgcagcattaattgtgaggtatgtgatgtactgactgcgcagaaatggaatatcgttgcaatgcttggcgtgatgaaagccgggggagccttcgtcccattggacccaagtcacccaacttcccgactgcaaggtctcatccaatcggttgaggcaccggttgtgctgtgctctcagcatcttgccgataaacttcgtccgatcgtaaagactttaatacccctctgtgctgatactctcgatcctctgtcggaccccaccgacagtgtcaatcttgcatctggtgtcacaagtcaaaatgcggcttatgttctgtttacctctggatcaacaggagaacccaaggttagacttttattaaaatataatttactcgaatagctgactcatgatttacaggggactctcttggagcaccgcgcgttcctgtccggggcgatggtgcatggacccgggctgcgcatttatcgcgactcgcgatgccttcaatttgccgcccacacattcgatgctagtttagccgagacattgacgccgctcattcatggtgcgtgcgtgtgcattccgagcgaggaagctcggctcaacgatattgtgagcaccatcaacgagatgcgagtcacccaagcttgcttcaccccgtcattcatcggctttattgaaatcgagagcgttccaggactggagagtttggtcctggccggggaggcaatgtcgcagtcacagctgactacctggtccaaaatcaaactggtcaatggttatggacctaccgaggccagcgtggcgtccgtcctcaactccaatgttacacctgacaccgattgcaaagatatcggactgcctattggtgtaagagcttggctggtgaaccctgataaccacgatgaactggtccccgtgggctgccctggagaactacttttggaaggcccacccctggcccggtgctacgtgaataatccccaaaagacaaacgaatcattcatctacgaccctgcttggactacattggaccctgaaactggctcgaatcgtagattctacaagacaggtgatctcgccaggtacaactccgacactggtgccctgaactacgtcggtcgcaaggatacacaggtcaaggttcacggacaacggatcgagctcggcgaaattgagaatcagctcagcaaagattcgaacgtcactcattgctctgtctttttccccaagactgggttttccaagggacgcctggcggcagttgtgtcgtccactggtttgcttgcggaacagtctgattcggacttggaacctctacgactagtccccgcctcgaaaaaggctgagcttgtccctggcatccgagagcgtctatcagctcgcctccccacttacatggtccctgcggtgtggttgtgtgtcgaagctctgccacttctgccatcagggaagctagaccgcaagggcatttccacttgggtcgccggtatggagagcgatccggatcttcagaacggtacctccgctgcaattgtcgacgcagaagcctcacagcccgccaacgacagagaggaagctttagccgctgtatatagccgtgtcctcaacattccccagaaccagctcaatttgaatgagagcttcctcgccctcggtggtgattcgatcgcagctatgacatgtatcggtctatgtaagaagcgagggtttgccctctctgtacaggagctacttcggagcaaatcaatccgcgacctcgcaactcgcgcaaagacgattgatcaccttacgacttacgaagaagctgttgacgaaccgttcagcctgtcccccatccagagccttcacttcggtgtacgcaaggagggccaaggccacttcaatcaaggaatcctgactcgcttgaataaacccgtcgacgaaaggaccctccgcaaggctgtcgaaacgctggtatctcggcactccatgctccgtgcacgattcactgacacaggtttcgcgacggcgtccagtcaacacattactcgcgatatcaagggatcttacagatggcgaatgcacactcttgccaacatgaacgaggtcgaaactcatgtcgccgacagccaatcctctatcaactgcttttctgggccactgctggcagtggattatttcttggtgaagggccggcctaatgtcctgtcaatgacagctcatcacttggtcgtcgacattgtctcttggagaattattctggaagatttggaagacatcattctaaaccccgagaagactggaaccagtgatggttcgttgcctttccagacctggtgccgcctgcagaatgagcactgcaacaccctacgtgctgagcacaaagttgcaactgatgctctcgctgtacccgactttggttactgggggctcaaagacactcaaactacttatggagatgtggattgtgcctcgtttgagatcgacccagctcataccaatgctattctgctggaatgtcacaaagctcttggcaccgagccaattgacttattcctggcagcaatgctccactcatttggccgcgctttccccgatcgttctcttccaacgatctacaatgaaggccacggacgcgaagtctgggacccgtccattgatatttcgcatactgttggctggttcaccattctgcacccaatctttgtctcagcatacaagtcagacagccccattgataccctcatccaggttaaggatcttcgccgtcgcgtcacggacaatggccgcgcagatttcaccagccgtgtactcccagctcagggcaatcaagggtccaagcaccctcatcccttcgagatgtcattcaactacgttggacaacaccgagatctacaaaggaaggatggtctcttccaacttgttgatcagatggcaggagaagctgggcaaggaggcggcgccgctgacttcggatcagatactccccgctttggtctgtttgagatctctgcgatggtcgtggctgggaaggttcgattcaacttctcctttaacaagttcatgcagcaccagaatcgtattcaccgatgggtttccgaatgccaggagctgcttgtaaccctctctgagcagcttccgaccctcgagccgcgtttgactctcagctcgttcccaatgctgtcgctgacctaccctaccttggacaagttgctcaatgaaaagttgcctgctatgggtattgagtcccctgactttgttgaggatatctatccttgttctcgcatgcagcagggtatcctacttggtcgcaagcgagatagctcctactatgctgtccacgacacctttgaaattcgggccactggatctggcaagccaaacctcgatcgcctggtcaatgcatggcagaaggtcgtttctcatcatgcgatgttccgcacaatcttcgttgagaacctcactcctcgcgaccccttctgccaggtcgtactgaagagttatgatgctactcctgttttcttgcagtcttcaggggaaaaggacgtgctggccacgtttgacaaggaagaccccaaggattacagcgagcctgaaccagcgtatcgtttctctatttgccagacacccactggcagactgtttgctcgcattgagatcagtcatgcggcgatggacggtaactccatctccatcattctccgtgacttacagctcgcatatgcaggcagactcgaggaaagccctcagcctttgttcaaggattatatccagtacatgcaggatgcgccgaacgaagctagcatcagctactggcgttcgtacttggatcaagctaagccgtgccacttccccgccctcactgacggccaacagtcagcaaaggcacttcggtctattcctgtcaactttggggccctagacgaactccaaactgtctgcgagaaacgcggaatcactctcgcaaatgtcttcaatgccgcatggggccttactctccgcgcgttctgtggatccgacgatgtctcctttagttacatggcttccctgcgtgatgtttctgctgacggcgtccagtgggtggtcggaccagttatcaaccttctaatctgtcgcatgaaggttgccgatgatgcgaagctcagtgatgtgctacaccaaatccagaacgactacatggaaagccttccttatcgtcacacttcgctcatcgagatccagcatgctttgaagctgtccgacaccaatttgttcaattccggtgtctcctaccgccgtcttcccagttctaaggatgctgtcagcagcgaaatcgagtgtgctgaggttggctcaattcacgatcccgccgagttcccggtattcatcaacatcgaggccatggataccacggctcgcattgacctcaactactggactacgaatctctctgattcacaggctgccaatgtggccaatacataccttcgatgccttgagaacgttgtgtcgaacattgactgtgaaatccgccagctaaacaacttgagcgaggataaccgtgcccagatcatggcgtggaacagtaagactcacaagcccttcgaaaagtgcgcccatcacgttgtccaagagatggccaagaagcgctctgatgccttggctgtaactgcttgggatgggaacttgacttactccaagttggatcaattctcctcccgattggcaggctatcttgtcactttcggtgtgggtcccggcacactgatccccatctgcttcgagaagtctatctggaacatagtctccacattggcaatcatgaaagccggtggtggctgtattccagttgacacacccgagagtctcgctgctgttgagaactggattgtcgacaacgccgtccaagtcgctctggcttccccggagaaggctcacgtcctcgaggatgccgtaccgtacgtcatccctgtaagcgagtctcttctcgagtacctcgcggacgaggatctcaaccccgtggcacaatcatcagacgtcgcatacgtcgctatgactgccggtacctccggccccgctaagagtgtcgtccttgaccattcaactgtcatgacccgagccgaggcattcgctaccaccatggcaattgccgatgtctccaggactctgcaattcgcaccccatacatccgatgcatttattgtcgaggcattcgccactttcatgtggggtggttgcatttgcattccggctgacattgaccctctcaacttggctgcctgtatcaatgcgctccatgttaatgtcgcgagcatcaccccgacagccgcaagcttcttctcccccaaggatgttccgggcctgcgatcgatcgccctcggcggcgaagttgtgccccagagcgtgctcgaccactggaagaccgacgacctccaattgcaggttttgtatggaacatgcgagagctcagcggcctccttccatgtgttctgttctcaggaggagcacgaggctgcgctcattggaaagagcacgtcctgtgtttcatgggtggttgacccctccaaccacgagaaccttgttccgatcggctctgtgggagaattggccctcgagggccctgttattgcctcgggctacctcgacgaccagtctgtagagaccagtgactttttcgagaacgctccttggctttctggacaacgaggagggcgtaaacaccgtcttttcaagaccggggatcttgttcggtacaaatccgatggctccctcgttttcgtcggccgaaagaatgataagagtcaatccgccttggctagcgagcttatccagactcagacgcgcatcgatacattcctggaaaagaagaagtgtgttgtggaaagcgtccagctgcaacgtggcgacatgaagacaaatgcccttgttgctttcgtggtcttctcggacaccatcccagtcacttatggggaccgcgtcctccagtccgcaacgcccggaatgaaagatgccatgtctagcttgcacgctagtctgagtaccagtcttcctggtagcaaggttccgagtttctacatccccatttcctccctccccttgaccgtctctggaaagctaaaccgccaggccctcaaattcgaaacacaagcgctctcgagcagtgctctcgaggctttcgacattaagcattggaacggatccaagactggtaaccgggctgcacggcaggccagtctctccgggcccaacatcgctttctggaaggagtatctcgccgacgttgagccctgcattttcccggcgctctcccatgaagcaagcgccaatgcccgctccattcgcacgctcaacaagcagtcagccaacatccatgccttcagcagattgtctggcctgcctgtagaaactctcttccagttcgcctgggcggttgttctccggtggtacactggctcagacgatgtttgctttggatattccgccgcagcctccgagacgaaatcggaggccgatggagtttccacctgccgtttcctcgtacagaacgagcaaaagctgcaggagactctccaaaaagcaaagagggactgtgagaccagtgcattgaatgtcgctcccttggacgcagtcaagcaccagcttggactcgataacacaacgctcttcaacacctccctgatttaccgcacggcttccaatctccccaagggaagtacccgggagccaagcacctctagtgcttacaagatcttggttgaagctgaagtctcgcattcgtacgccgagatacacttcacctactcctcagacaccctttcctccttccaggtcagccatgtcatggacatgtttgaccaagtcttggacgatttgatagcccacaacctccgtgaccgcaccataggggacgtcaatgtactccctgaacgctcagttcgtcgaatccgcgattggaatgccgcatcccctcctagagtggagaaatgcgccgacgaactcatccagcagcaggccctcctccacccccgcgccgaagccgtctgctcttgggacaagaatttcacctatgggcaacttgaaattgtgtccagtcgcctggctcgtcatctctccagccttggagtcaagcccgaagcctttgtggtgttgtgcttcgagaagtcagcttgggctgtagtggcccagctggctgttctcaaggcgggtggagccttcgtctcgattgacccatcccaccccgattctcgactgaagatgcttatcgatgaaattggcactaaccttgtcttgtgctcgtcctcagtccacaccaaggtttcgaaactgtgcactaaatcattcgccgtctgccagacttcaatctcccaacttcctgattcgcctttggctctgcccggtgctcgtcctactccaaacaatgctgcatatgctatatttacctctggtactactggaaagcccaaggcaactgtcgtcgaacatactgcccttagcaccaccgcgatcgccatgatcgacggcctgcacatgaactccacaacccgtgctttgcagttctctaactacacctttgacgttagcatcttggagatcatgatgattctcatgactggtggctgtgtctgtattcccagcgaggatgagcggatgaacaacttgggtggtgccatccgccgaatggaagccacctacatctcggcacctcctgccattgtcaatacactagagccgaaaaacgtccctagcctcaaggtcattatcacaggcggcgagaagatgcccgccaaccatattgaccgctgggcagaccggtgtgtcatcaatgcctatggtccctccgaggcgacagtcgttgctacagttggtgtcaaggttgattgggatggaaaccgtgtcaacgatgaccccacatctattggaacatctccaaattgcagagtctggattgtcgatccgaacaactccaaccgtctgctgcccgttggcgctgtcggtgagctgatccttgaaggaagcaacattgcccgtggataccttgccaacgaggaaaagacgaaggcctctttcttcgagaatcctgtgtggaaccgtcattccggcttacagggcgtgttcaagcggaacgatcgcatgtaccgtactggtgatcttgttcgctacaacagtgatggcagtctggctttcatctcccgcaaagacactcagatcaagttcaacggccagcgaattgaactggaggagattgaacaacaatgtatccgctgcctacctgaagattctcaggttgctgttgacgtcgttgtccccgaggaacggaccatcgccaagggtctcgccgcattcttcacggttcatgacccagattccaacggcggcagcaacgatcaatttgcccccacggttcctggagccgatccactgctcctgcctatctccatgtccaacatggatgccattcagaagttgaagggctctctgcccgaactcctacctcagagcatgatgcctcgactcttcttccctatccgcaacttgcccttcacttcctcgggaaagattgaccgccgaagattgcgggccatggtacaaaccttatccaaggatactcttaagtcttacattaccctcaccacctccgacagacgggagatttcctcagctaccggcctcgagatcaagctggtggcccttgtcgaaaagaccctcgagcttgaagctggatctgtgaccgtcgatgacagcttcttcggtctgggtggtgattccttgtccgccatgaacctcgtcggcgctgctcaagcagaaggcatcgcactcaccgtctcgggcatcttcaattccccgatattggttgacatggccaagagctgcgtcgtgtctgacggccctgctgaagttaagaaagaagatatcaaggcattctcattgctgccctctggagtctacctcgaaaatctgatggatgaagtcaccgacagctgcgaagtgtccaaggaccttatcagcgatatttacccatgcagcgctgtgcaggagggtcttctcacgctctctatcaagcataacggtgcttatgttgctcagccctcgttccgtcttgctgctggcattgatgtcggtaaattcaaacaggcctggcagcaaacggtgtcagacttggaaatccttcgcactcgcattgtccacactgaagctatgaactttgctcaagttgtcctcaaggatggccccatctcctgggtcgaagcagagtcgttcgattctctgcccaacgatttccttcaccttcccaagcaaaatggagcagctctcactggttacgccatggtgcatccccgtggctcgtctgacagctactttgtgtggtctgttcaccacgccctttatgacggctggagtattcctctggtattccgcaaggtcgaagagaactacttttcctcacagcccaagcgcgctggcaccccttacagtctgttcatcgactatctggctaagaaggatatggaggagtctgatgctttctggaagtcttacctgactgatctgtccagcactcctttccctcataacaagaacgctgttcctgatgccatgcgtgctggcaacacccagtatcacaacatgaaactttcccgcacccgcaacagcgtcgactttacgatccccgtcctcatgcgcgctgcatgggcaattgtcattgctacacacactgcctccggtgatgtgtgcttcggcgagactctgtcgggtagaaatatcgatctccccggtgttgcagatattgctggtcctgttctgaccactgtccccacccgagtccaggttgacaatgctatgtccactatgcagtacttgcagaagatccaccagtcgaccaccgagatgatcccacatttgcactctggtcttcagcgtatccggcaactgaacaaggatacctccgagggttgcaatttccaaaacttgcttgtgatccagccaggcgatggcgaactcgacaacaagatctggatcgacgagaaacgtgaaacaagcgaagacttcttcactcacccccttgttgtggaatgtggaatcacgaagacaagcatctccttcaccgttcaccacgatgagcttgtcatcagcggatggcacaccaagcgacttaccgaacaatttgcacatgttctgcagcagttgattgccttgcctaagaacagcacgagcaagctcgaagatttggaggtcgtaagccccgaggacaaggctgaaattggtacatggaacgagcgcattcccctcacagtggaacgaaccgtccaagatttcattcgtgagaagtccgaggagactccgaatgcccaggctgtatgtgcctgggatggcgacatcacctacagagaattctggaacctggcctctggctttgccaactaccttgtctctcgcggagttggcccagaagtgtttgttccggtctgtctggacaagtcagcttgggcaatggtcacccttatcagtattctcatcgccggtggtgggtacgtacctttggatccctcccaccctacctcgcgacacgaggaaatccttgccgacgtcggtgccaacatgatactatgcacccccaactatacaaaccgctacagtcgggttgtgaagactgttatccccatcagcaaggagacgatcaaggcctatggcgcactcaagtcatcttcccgtcgccgaactgacgtcaaacccaccaacatggcttatgctctattcacctctgggagcactggtcgggccaagggaattattgtcgagcaccgcaatgtggtcagcagcatcatggcattcgccccgtgggtacgcatggatgagacatcgagagtattccaattcgcctccctcacttttgatgctgctgttatggagactcttgcgattctcatgctcggaggtaccatatgtgtgcccagcgaagatgaccgtctcaacgatgttgcgggcgcaattcgtcgactcaatgtcacttggacgttcctcaccccttcgattgcaagcatcattgagccatcctcagtgccttctctcaagcacctcgtttgtggtggagagaagatgtctaatgaagtcatcaccaagtgggccaattctgttcacctcatgaatgggtacggaccgaccgagacctgtgtctttgctgtgatcgacaatgcagtggccactaaccgtgatcccgggcgtatcggttacggtattcccagcactctcacttggattgttgaccccgacaaccatgatcggctgactcctctgggcgcagtcggtgaacttgcacttgaaggtgctccgttggccagagagtacctcaaaaaccccgagaaaaacgcagaagcattcacttcggaccctgcctggatcaaggacttcacccctgcgatcccgggtcctcgccgaatctacaagactggcgatctttgctactacaaccctgacggatcaattcagtacatcagccggaaggatcaccaggtcaaattgcatggccagcggatggagcttggtgagatcgagcatcgcctctctgaagatgctcttacccgccacgctgtcgtcgtgctccccaagaacggcccgcttaagcagcgcctggtcactgtgatgtctttgaacagtgtggcagctgataccaagcttatttctgacaagccctgtgagcttgttgacgagaatgagcttgagcgccacgcttacaacgagctggtcgaagtgcagaagaatcttgagaaccagctgcccatttacatggttccgcagacttgggctctcattaagaagcttcccatgctcgtttcgggaaagctcgaccggaagaagatcactgcttgggttgaggatattgatgatgcatcctacgagcgtatcatggccgattacgatcgcatcaagcgtggcaagatcgaggagaagccgcaagaaaaggaagagaagcatggatcgctcagcattatccgcgagatctttgcacaagtgttgaatatctccctacagaaggtcaacgtcgatcgctcctttgtcagcttgggtaagtatcccgtcattccaaagcattgaatatactaaccggttctcacaggcggcgacagcatcactggaatggctgtcatttctcgcgctcgcaaacaaggacttgtcgtgacactacacgacattctgcagagcagatcactgaaggaacttgctcaaactgccagctccaaggcgcctgtttcacagcgcgaagagaagtctggtgatggtttcgcactctctcctgtccaaaggctctacttccagagctcggactcgttcaagggcgccgctcgcttcaaccaaagcatgactgttcgcatcgctcgtcgttgtgagggtgaggtcctcaagcgcgccgtcaaggctgttattggccagcatgccatgttccgcgcgcgcttcagcacatctagtgacggcacttggcaacagaaaactgcagcggtaggctccctacaaatccctgatcgaacattttctaactcaacctcacaggaggtcgatgaatctttccaattccgcgttcactctgtggccgatatccgtgggatggttccaaagattgctgagagtcaaaattgtctcgatcctctcaatggacctattcttgcagccgacttgtttaaccttcgcaccggtggtcaggtcttattcctcgtcgctcaccatctctgcattgacatggtatcatggcgcatcgtgctccaggacctcgaagagctcgttgtctctggatctctttcactcgacaaagcattgtccttccaaagctggtgtgccatgcagacggagagagccaagatacaggatgcgactatttctctgcctttcactcctgagaagccgagcttgctttactggggcatgcaaggttcacccaatgtttacggagacatcaagatggaatccttcatgttgagtgaggatactaccaaattcatcctggatggctgccacagtgtcttccggactgacactgtcgacattttgctgtctgccatcatttattccttcggtcgcaccttcactgatcgcagggtgccaactatttacaacgaaggacatggcagagaagcctgggaagccgacattgatctttccagaacagttggctggtttaccacaatggcccctttgctagtggactccgaagctcgtaagtttcccatacctcatcttgttgacagacagctgacacaacaaggtgccctcaacgacattatcaagcgtgtgaaggacaccaggaggaagatcgcagacaatgggcgtccttacttcgccaaaaacctgcttcaagaccagggttccgatttccctgtcccgttagaaatcctgttcaattacctgggtaagatgcagcaacttgagcgagctgattcgctattccatcaccatggtagcgtctttgacagctcggactttgctgtcgcaggtgacatgggcccccagactgctcgtttcgccctcttcgaggtatccgccattgtcatcaaagaacgccttaatgttgctttcacctacaacaacaaaatgcagcatcagggctctattcgccgctggattctccaatgcaagcagaccctcgataaggatatcctcaccctcaaaacggccactccagagcccactctcagcgactaccccctcctcccaattaactatcacggcctccagatgctcactgccagcaccttccgcaaggccggcattcggaacaaggacgacgtcgaggacatatatccctgctctccgatgcaggagggactcttgctcagccagctccgcgatcccaatgcgtacatgttccatactgtgtttgagatcaaggatggcaaatctggcaaggtcgacgctgagggagttgcccgcgcttggcaggccctcgtcgaccgtcatcctgtgctccgaactattttcgtcgacagcaactacacgggcggatccttcgatcaactggtgctcaagaatctttccgacaatatcttacgcgtgcaatgccaggactcacaggttgaggagaagctggctgccatttccctccgtgacaggaacgcaatgcgccaagcgaagctttctcatcaattgacagtttgcaaaacgaacaccggacgtgtaattctcaagctggagatgaaccatgccatcatcgacggtggctcggtggatgtactcctccgtgacctgactctcgcctacgagcgaaaaattgccgagggttcaggacctctcttcagcgactacatcaaactcatcaggactcaaagccatagtgacgcactcagtcactggaaggaatacctcggcggagttcacccatgtcacctcgccccatcggctgtgttcgaagccaagagggaactaaagggtgtcaagatgaacttccagcgattccctgagttgcttaaattctgcgagcgaagctcggtgactctcgctaacttaaccctttccgcttgggccatcgttttgcgacagttcgttgggtccgatgacgtttgtttcggatatctctctgccggtcgcgatgcccctgtcgatggcattcaggacatggttggaatctttattaacatgctttgctgccgagtccagttctccgatcagcagaccctgacggatgtgtccaagagtgttcaggatgattatattcgatgcattccccaccaaagctgctctttggcgagcattcagcatgagcttggttggcagggacagtccctcttcaatactaccttgtcgatccagaaccactccgttgcgggtggtcccaaggacaagggactgtccttcgatcttcaacatgcacatgacccgagcgaggtgagtatccgtcctatcaatgcgtcggttcaactactaactaaatacagtacgcggtcactgtgaacgttgagattgcgcgaggccaggagggtattcttttgagatactggaatgatattgtgtctgacgaggaggcacagagcctggctgacaccatcgccaaggtgttcactggctttattgagtccccggctgcgactctgtcgcagtccacattcgcttctgaggctgaacctgagtcggtggattgggatcgctcccaaaccacactggctgacaaggcaaagtcgaccggagaggctattgacagcagtgctatgcagaaaattattgatgatcgtgttcatgagattattgggcagatgttgagagaaggaaaactgacggtgcctcccattcgcacagaagggttgtcaagctatggcggtcacactgataccatagccgactcaccgtaccagttaggtatacaaggagcagatgattcgggtgtttgttcggcgacttcccgttccagcgaggatgggatgtcggtcgatgtggaaaggaaattgtggaatctttggagcacagctcttggcctctcacctaacgtggtgagacaccaggacagcttcttcaagttgggcggtgacagcatcaccgccatgaagatggtcagtgccgctcgtgaagagggcctggtccttactgttgcagatgtcttcaacaatcctgtcttcgaggacatgttgacaacggtgcgagccgccaatgtcactcagcagatgctgaatgccgatctcaagtcaggcggccacaaggaggttgacagtgatttactcaatatcaccccaacgacactggggcccagcccctctaccgagagcctcgaggttctcaagccatcgtgtgtcgatgatgccgcggtgcagcgcggtatctgtcccaaggttggtgtattcaagggtggcatcgccgatgtcctccctgtcactgacttccaggcgatgtctctgacggcgactctcttcaagtctcgatggatgcttaactacttctatcttgagggcaacggtcccctggacctgagacgccttcgcgagagttgcttgaaggttgtcgctgcatttgatattctgcgcacagtctttgtgtgcttccatgaccagttcttccaggtcgtgctgcgcaagatccgtcccagcatcttcgtttatgagacggaccgcgctcttgatgaattcaccatgacccttcaacagagagatcgtgaatacggaccgcgcgagggcgagcagtacgtgcagttctacgttgtcaagaagaagaacagcgaccagcaccgtatcatgatccgcctctctcacactcagtacgatggagtgtgcttgccaaagatcatggctgccattaagcacggatatgaaggcaccccactgcctccggttacccccttcgctggttacttgcgacagttgccaggaacaatcaccccggaccattaccgccactggacggaccttctcaagggctctcatatgacccaagttgtccgcagacgcggtaccagcatgttccagaacgttggagcattcaccgagatccacagaaagattgagatctcgcccactgccctcggaaatgtcactatcgcaactgtcatgcaggctgcctgggccctggcccttgccaagctctctgctcagtctgatgttatctttggcctgactatcagcggccgcaacgccacagtgcccggtatcgagagcaccgttgggccctgtgtcaatgtcatcccggtccgcgtgaagttcgatgagaaatggaccggtgtcgatctattccgctacctccaggaccaacaggtctccaacatgcctttcgagtccctgggcttccgcgagatcatcaagcaatgtaccgactggcccgactggacctacttcaccacctcagtcttccaccagaacgtcgactacgaaggaaacatgcagctcgacaacaacaagtaccgcatgggtggtgtcggcgtcaatgacaacctagccgatctcaccatggtatcccgtccttccggcgaacgaggcctcgatgtcaccctcggctactccgaaaagggccctgtgatgccatcgttcgcatccaaggttctcgacatggcctgtgagattgcgcaatccctcgtcgccaacccaaccgcctccctgccctccgccagcatgctacgctccctgccaccgcagacaatcgacgatcaaccccgaccaacagacgagcacttcctcagcgcgcacctcaagtcgcgctccatcgcagagctgctcgtgcattcagacattctgtctcgctcgtggcaccaggtcctgcccagtcgcaccacgaccggccccgtcgacccagaagcggacaaacccacccaccaatccgccttccagttggactcgtccttctttgatctcggcggtgacgtcttcaatttagcccagcttacctggctcctggagcaagagggtctcaaggttcgtctggaggatcttattgagcacccctctttcctgggccaaatggccgtgctggctttgcataacgccaagcaccaggaggatatgccaacggagcttcttgctaccggtgctgcaccgcctgatcctgtcgctcgcattgaaaagaagaagacatggtccaaggccatgaccatagcgagaaagttgactgggcgaaacacggtcaccagtcgagcttgataccatgatcaaggtcgaatccgcgaaggaaatagagaaaagcaaaaaagaaaaaaaaaaaaaaaaaaaaaaaaagagagaaagcaaaaacaggtgttggcctcaaaggctagacgaaacccaccaagaaaaactcgctttcctttgtcatttcttatgcctctgcatgtttatgttgcatgttttgtattatggtctttgtacggctttggctttttggctttttggctttggattgggtacatatggcattcaatcgtctctactcactatattctgtctttgtgtcttgttcacgtgtcttttcgtgtttactctgctatttttgtgcttgctgcttctttgttatactctaatacgcggaaacttgtctattgaatattctccctgtaggaaagtaaagtagaatctttagaccagatcctgatatcatactttgtaagaaataatatgactcaatctgagacgctgaaacaccgagggtataaatgcatgggatggacgtgtcaaaacagaaaccaggtcgtcatctgatgtgctcataacccagtagtagaaaacatgtacaataaaaccatacagaattaatcatgtcgaatcttaaaccgagtctcgcgaccacgtcccgcgtgctcgaatccgcttcccgaacttatagaacaaatatggaatgggaatgagagcaacagaaatgaagcccagcacgctagcagcccacggaacaccaagattatggaacatggcagccgtgaagagcgggaaacagcccgcgaacatcgagcgcaggaaagtatttgccgcgatcgcgctagcagagtatttctggaatgtatcaatgaggtagttgagagcagcttggaagatggtgaaaaagcctaagcccatcatgaccgcaccgatattcggacagatccaatggatgtgttttgggcttgtccagccgaagacgaacatcccacttgcgaagaggacagatccgatcatcatgggcggaagacgggcttctgggacggggcggttgttgttcgctttgaagcgctttatgtagaatttctggttggcgaggttgatacctccgcctattaggattccgactaggtatgcgaggaaagggagggcgccgacgacttggttccagccgcggagttcctggaagacgattgggaaggctgctagactgagatagaggatgccgtagacgaaggatgcgtagagggcgacgaggaagcagattggggttgcgaggagttggaagggacggacgaggtacttgttgcctatttctttgagagtcacgtcccattcctcgtggcgtgcatggagggcccagttgccgctctcgaagcggagtcgacgggccttgtagaccagcagaactggtgggtagctctcatcgacgaagaggaggtccatgattaggaagaacatcatcatgataccggtgatctggtaggtattagcatgggttcaaccccacgcagaaaaactcacatattcagtccagcgccagcctagattgctctgcacgatggcaccacccgcgataggcccgatgacaggcccgcccactacggccatggcatagccgacaatggcggcaccacgctcttcggggctccagatatcacttaggactccgccggtgttggtaacaggtgccgagccgaaaaagcccgtaaagaatctagtgatcataatagtctggacgtcttttgcggtggctgttgcgaaggaaaagatcgccgcgagaaagtatggcggtagaactgccgttttgcgtccatagagctcagacagaggtgcccagatcaacgggcccaatcccaagccgaacaaaagtaacgaggtgccgagtgtagcgacctcattcgagatgccgaactcctggctaatctgtatctgaccagtggagtagctagcagtgtaattagtttaccaatgcataaataaaccttgcagctaaagcaaaatgaaatagacatacattgaactggcccat

SEQ ID NO: 32 - DNA, 18195 bp, Penicillium chrysogenum
atggctcaatccaccaagtgctatcttcctcggttcgcttcgacggttgacgggcctaaacgcccagtctcgatgaagacgagacccacggctgctcagcatgcgcagttattaaccgcatggaacgaaggccgtctggaccccatcctacgagccacctgggctctcttgttgcactactatatccgctccgaggatatatgcttcggttaccaacatctcgagggcgactcgcgctctcccaaatcatctgtacagcgttctaccgtcaacatttcgacgatccgcatatccatcaacgacaacgactctctcaaagcaattgtagataaggtgcgcgcaaacagtgcgattcgccagaacaatggaagccccgaggcttccgaggcatatcttcctttcaacaccatcttcatgctgcgcacatacgacccgcctgcttctccttcaaaacctattctggcgacagctattccggacgagtgtcaagtccgtcttcatgtcaaggtgctgcgtggagacatcagcatcttcctcgaatggcgcaagggtgacatgtccggggaacagatgaagagtatcgcaaacatttttgagcagttgcttgccaaagtgctttctgccgagaacaccgctattagccagcttaatttgttctcggagaacgactggcaacgcatccgcaagtggaattccactactccacagcttcacgatcgctgcattcacgaggccatccacgatcaaatgttgagcggacctgatcgtgaggctgtgtgtgcgtgggatggaagtttgacgttcgccgagttggatcaccaagcgtcgaagcttgcatgctatcttcgcatgcagggagtcgggccggaaatccgcgtggctttgtgttttgataaatcgaaatggaatatcgttgcaatgcttggcgtgatgaaagccgggggagccttcgtcccattggacccaagtcacccaacttcccgactgcaaggtctcatccaatcggttgaggcaccggttgtgctgtgctctcagcatcttgccgataaacttcgtccgatcgtaaagactttaatacccctctgtgctgatactctcgatcctctgtcggaccccaccgacagtgtcaatcttgcatctggtgtcacaagtcaaaatgcggcttatgttctgtttacctctggatcaacaggagaacccaaggggactctcttggagcaccgcgcgttcctgtccggggcgatggtgcatggacccgggctgcgcatttatcgcgactcgcgatgccttcaatttgccgcccacacattcgatgctagtttagccgagacattgacgccgctcattcatggtgcgtgcgtgtgcattccgagcgaggaagctcggctcaacgatattgtgagcaccatcaacgagatgcgagtcacccaagcttgcttcaccccgtcattcatcggctttattgaaatcgagagcgttccaggactggagagtttggtcctggccggggaggcaatgtcgcagtcacagctgactacctggtccaaaatcaaactggtcaatggttatggacctaccgaggccagcgtggcgtccgtcctcaactccaatgttacacctgacaccgattgcaaagatatcggactgcctattggtgtaagagcttggctggtgaaccctgataaccacgatgaactggtccccgtgggctgccctggagaactacttttggaaggcccacccctggcccggtgctacgtgaataatccccaaaagacaaacgaatcattcatctacgaccctgcttggactacattggaccctgaaactggctcgaatcgtagattctacaagacaggtgatctcgccaggtacaactccgacactggtgccctgaactacgtcggtcgcaaggatacacaggtcaaggttcacggacaacggatcgagctcggcgaaattgagaatcagctcagcaaagattcgaacgtcactcattgctctgtctttttccccaagactgggttttccaagggacgcctggcggcagttgtgtcgtccactggtttgcttgcggaacagtctgattcggacttggaacctctacgactagtccccgcctcgaaaaaggctgagcttgtccctggcatccgagagcgtctatcagctcgcctccccacttacatggtccctgcggtgtggttgtgtgtcgaagctctgccacttctgccatcagggaagctagaccgcaagggcatttccacttgggtcgccggtatggagagcgatccggatcttcagaacggtacctccgctgcaattgtcgacgcagaagcctcacagcccgccaacgacagagaggaagctttagccgctgtatatagccgtgtcctcaacattccccagaaccagctcaatttgaatgagagcttcctcgccctcggtggtgattcgatcgcagctatgacatgtatcggtctatgtaagaagcgagggtttgccctctctgtacaggagctacttcggagcaaatcaatccgcgacctcgcaactcgcgcaaagacgattgatcaccttacgacttacgaagaagctgttgacgaaccgttcagcctgtcccccatccagagccttcacttcggtgtacgcaaggagggccaaggccacttcaatcaaggaatcctgactcgcttgaataaacccgtcgacgaaaggaccctccgcaaggctgtcgaaacgctggtatctcggcactccatgctccgtgcacgattcactgacacaggtttcgcgacggcgtccagtcaacacattactcgcgatatcaagggatcttacagatggcgaatgcacactcttgccaacatgaacgaggtcgaaactcatgtcgccgacagccaatcctctatcaactgcttttctgggccactgctggcagtggattatttcttggtgaagggccggcctaatgtcctgtcaatgacagctcatcacttggtcgtcgacattgtctcttggagaattattctggaagatttggaagacatcattctaaaccccgagaagactggaaccagtgatggttcgttgcctttccagacctggtgccgcctgcagaatgagcactgcaacaccctacgtgctgagcacaaagttgcaactgatgctctcgctgtacccgactttggttactgggggctcaaagacactcaaactacttatggagatgtggattgtgcctcgtttgagatcgacccagctcataccaatgctattctgctggaatgtcacaaagctcttggcaccgagccaattgacttattcctggcagcaatgctccactcatttggccgcgctttccccgatcgttctcttccaacgatctacaatgaaggccacggacgcgaagtctgggacccgtccattgatatttcgcatactgttggctggttcaccattctgcacccaatctttgtctcagcatacaagtcagacagccccattgataccctcatccaggttaaggatcttcgccgtcgcgtcacggacaatggccgcgcagatttcaccagccgtgtactcccagctcagggcaatcaagggtccaagcaccctcatcccttcgagatgtcattcaactacgttggacaacaccgagatctacaaaggaaggatggtctcttccaacttgttgatcagatggcaggagaagctgggcaaggaggcggcgccgctgacttcggatcagatactccccgctttggtctgtttgagatctctgcgatggtcgtggctgggaaggttcgattcaacttctcctttaacaagttcatgcagcaccagaatcgtattcaccgatgggtttccgaatgccaggagctgcttgtaaccctctctgagcagcttccgaccctcgagccgcgtttgactctcagctcgttcccaatgctgtcgctgacctaccctaccttggacaagttgctcaatgaaaagttgcctgctatgggtattgagtcccctgactttgttgaggatatctatccttgttctcgcatgcagcagggtatcctacttggtcgcaagcgagatagctcctactatgctgtccacgacacctttgaaattcgggccactggatctggcaagccaaacctcgatcgcctggtcaatgcatggcagaaggtcgtttctcatcatgcgatgttccgcacaatcttcgttgagaacctcactcctcgcgaccccttctgccaggtcgtactgaagagttatgatgctactcctgttttcttgcagtcttcaggggaaaaggacgtgctggccacgtttgacaaggaagaccccaaggattacagcgagcctgaaccagcgtatcgtttctctatttgccagacacccactggcagactgtttgctcgcattgagatcagtcatgcggcgatggacggtaactccatctccatcattctccgtgacttacagctcgcatatgcaggcagactcgaggaaagccctcagcctttgttcaaggattatatccagtacatgcaggatgcgccgaacgaagctagcatcagctactggcgttcgtacttggatcaagctaagccgtgccacttccccgccctcactgacggccaacagtcagcaaaggcacttcggtctattcctgtcaactttggggccctagacgaactccaaactgtctgcgagaaacgcggaatcactctcgcaaatgtcttcaatgccgcatggggccttactctccgcgcgttctgtggatccgacgatgtctcctttagttacatggcttccctgcgtgatgtttctgctgacggcgtccagtgggtggtcggaccagttatcaaccttctaatctgtcgcatgaaggttgccgatgatgcgaagctcagtgatgtgctacaccaaatccagaacgactacatggaaagccttccttatcgtcacacttcgctcatcgagatccagcatgctttgaagctgtccgacaccaatttgttcaattccggtgtctcctaccgccgtcttcccagttctaaggatgctgtcagcagcgaaatcgagtgtgctgaggttggctcaattcacgatcccgccgagttcccggtattcatcaacatcgaggccatggataccacggctcgcattgacctcaactactggactacgaatctctctgattcacaggctgccaatgtggccaatacataccttcgatgccttgagaacgttgtgtcgaacattgactgtgaaatccgccagctaaacaacttgagcgaggataaccgtgcccagatcatggcgtggaacagtaagactcacaagcccttcgaaaagtgcgcccatcacgttgtccaagagatggccaagaagcgctctgatgccttggctgtaactgcttgggatgggaacttgacttactccaagttggatcaattctcctcccgattggcaggctatcttgtcactttcggtgtgggtcccggcacactgatccccatctgcttcgagaagtctatctggaacatagtctccacattggcaatcatgaaagccggtggtggctgtattccagttgacacacccgagagtctcgctgctgttgagaactggattgtcgacaacgccgtccaagtcgctctggcttccccggagaaggctcacgtcctcgaggatgccgtaccgtacgtcatccctgtaagcgagtctcttctcgagtacctcgcggacgaggatctcaaccccgtggcacaatcatcagacgtcgcatacgtcgctatgactgccggtacctccggccccgctaagagtgtcgtccttgaccattcaactgtcatgacccgagccgaggcattcgctaccaccatggcaattgccgatgtctccaggactctgcaattcgcaccccatacatccgatgcatttattgtcgaggcattcgccactttcatgtggggtggttgcatttgcattccggctgacattgaccctctcaacttggctgcctgtatcaatgcgctccatgttaatgtcgcgagcatcaccccgacagccgcaagcttcttctcccccaaggatgttccgggcctgcgatcgatcgccctcggcggcgaagttgtgccccagagcgtgctcgaccactggaagaccgacgacctccaattgcaggttttgtatggaacatgcgagagctcagcggcctccttccatgtgttctgttctcaggaggagcacgaggctgcgctcattggaaagagcacgtcctgtgtttcatgggtggttgacccctccaaccacgagaaccttgttccgatcggctctgtgggagaattggccctcgagggccctgttattgcctcgggctacctcgacgaccagtctgtagagaccagtgactttttcgagaacgctccttggctttctggacaacgaggagggcgtaaacaccgtcttttcaagaccggggatcttgttcggtacaaatccgatggctccctcgttttcgtcggccgaaagaatgataagagtcaatccgccttggctagcgagcttatccagactcagacgcgcatcgatacattcctggaaaagaagaagtgtgttgtggaaagcgtccagctgcaacgtggcgacatgaagacaaatgcccttgttgctttcgtggtcttctcggacaccatcccagtcacttatggggaccgcgtcctccagtccgcaacgcccggaatgaaagatgccatgtctagcttgcacgctagtctgagtaccagtcttcctggtagcaaggttccgagtttctacatccccatttcctccctccccttgaccgtctctggaaagctaaaccgccaggccctcaaattcgaaacacaagcgctctcgagcagtgctctcgaggctttcgacattaagcattggaacggatccaagactggtaaccgggctgcacggcaggccagtctctccgggcccaacatcgctttctggaaggagtatctcgccgacgttgagccctgcattttcccggcgctctcccatgaagcaagcgccaatgcccgctccattcgcacgctcaacaagcagtcagccaacatccatgccttcagcagattgtctggcctgcctgtagaaactctcttccagttcgcctgggcggttgttctccggtggtacactggctcagacgatgtttgctttggatattccgccgcagcctccgagacgaaatcggaggccgatggagtttccacctgccgtttcctcgtacagaacgagcaaaagctgcaggagactctccaaaaagcaaagagggactgtgagaccagtgcattgaatgtcgctcccttggacgcagtcaagcaccagcttggactcgataacacaacgctcttcaacacctccctgatttaccgcacggcttccaatctccccaagggaagtacccgggagccaagcacctctagtgcttacaagatcttggttgaagctgaagtctcgcattcgtacgccgagatacacttcacctactcctcagacaccctttcctccttccaggtcagccatgtcatggacatgtttgaccaagtcttggacgatttgatagcccacaacctccgtgaccgcaccataggggacgtcaatgtactccctgaacgctcagttcgtcgaatccgcgattggaatgccgcatcccctcctagagtggagaaatgcgccgacgaactcatccagcagcaggccctcctccacccccgcgccgaagccgtctgctcttgggacaagaatttcacctatgggcaacttgaaattgtgtccagtcgcctggctcgtcatctctccagccttggagtcaagcccgaagcctttgtggtgttgtgcttcgagaagtcagcttgggctgtagtggcccagctggctgttctcaaggcgggtggagccttcgtctcgattgacccatcccaccccgattctcgactgaagatgcttatcgatgaaattggcactaaccttgtcttgtgctcgtcctcagtccacaccaaggtttcgaaactgtgcactaaatcattcgccgtctgccagacttcaatctcccaacttcctgattcgcctttggctctgcccggtgctcgtcctactccaaacaatgctgcatatgctatatttacctctggtactactggaaagcccaaggcaactgtcgtcgaacatactgcccttagcaccaccgcgatcgccatgatcgacggcctgcacatgaactccacaacccgtgctttgcagttctctaactacacctttgacgttagcatcttggagatcatgatgattctcatgactggtggctgtgtctgtattcccagcgaggatgagcggatgaacaacttgggtggtgccatccgccgaatggaagccacctacatctcggcacctcctgccattgtcaatacactagagccgaaaaacgtccctagcctcaaggtcattatcacaggcggcgagaagatgcccgccaaccatattgaccgctgggcagaccggtgtgtcatcaatgcctatggtccctccgaggcgacagtcgttgctacagttggtgtcaaggttgattgggatggaaaccgtgtcaacgatgaccccacatctattggaacatctccaaattgcagagtctggattgtcgatccgaacaactccaaccgtctgctgcccgttggcgctgtcggtgagctgatccttgaaggaagcaacattgcccgtggataccttgccaacgaggaaaagacgaaggcctctttcttcgagaatcctgtgtggaaccgtcattccggcttacagggcgtgttcaagcggaacgatcgcatgtaccgtactggtgatcttgttcgctacaacagtgatggcagtctggctttcatctcccgcaaagacactcagatcaagttcaacggccagcgaattgaactggaggagattgaacaacaatgtatccgctgcctacctgaagattctcaggttgctgttgacgtcgttgtccccgaggaacggaccatcgccaagggtctcgccgcattcttcacggttcatgacccagattccaacggcggcagcaacgatcaatttgcccccacggttcctggagccgatccactgctcctgcctatctccatgtccaacatggatgccattcagaagttgaagggctctctgcccgaactcctacctcagagcatgatgcctcgactcttcttccctatccgcaacttgcccttcacttcctcgggaaagattgaccgccgaagattgcgggccatggtacaaaccttatccaaggatactcttaagtcttacattaccctcaccacctccgacagacgggagatttcctcagctaccggcctcgagatcaagctggtggcccttgtcgaaaagaccctcgagcttgaagctggatctgtgaccgtcgatgacagcttcttcggtctgggtggtgattccttgtccgccatgaacctcgtcggcgctgctcaagcagaaggcatcgcactcaccgtctcgggcatcttcaattccccgatattggttgacatggccaagagctgcgtcgtgtctgacggccctgctgaagttaagaaagaagatatcaaggcattctcattgctgccctctggagtctacctcgaaaatctgatggatgaagtcaccgacagctgcgaagtgtccaaggaccttatcagcgatatttacccatgcagcgctgtgcaggagggtcttctcacgctctctatcaagcataacggtgcttatgttgctcagccctcgttccgtcttgctgctggcattgatgtcggtaaattcaaacaggcctggcagcaaacggtgtcagacttggaaatccttcgcactcgcattgtccacactgaagctatgaactttgctcaagttgtcctcaaggatggccccatctcctgggtcgaagcagagtcgttcgattctctgcccaacgatttccttcaccttcccaagcaaaatggagcagctctcactggttacgccatggtgcatccccgtggctcgtctgacagctactttgtgtggtctgttcaccacgccctttatgacggctggagtattcctctggtattccgcaaggtcgaagagaactacttttcctcacagcccaagcgcgctggcaccccttacagtctgttcatcgactatctggctaagaaggatatggaggagtctgatgctttctggaagtcttacctgactgatctgtccagcactcctttccctcataacaagaacgctgttcctgatgccatgcgtgctggcaacacccagtatcacaacatgaaactttcccgcacccgcaacagcgtcgactttacgatccccgtcctcatgcgcgctgcatgggcaattgtcattgctacacacactgcctccggtgatgtgtgcttcggcgagactctgtcgggtagaaatatcgatctccccggtgttgcagatattgctggtcctgttctgaccactgtccccacccgagtccaggttgacaatgctatgtccactatgcagtacttgcagaagatccaccagtcgaccaccgagatgatcccacatttgcactctggtcttcagcgtatccggcaactgaacaaggatacctccgagggttgcaatttccaaaacttgcttgtgatccagccaggcgatggcgaactcgacaacaagatctggatcgacgagaaacgtgaaacaagcgaagacttcttcactcacccccttgttgtggaatgtggaatcacgaagacaagcatctccttcaccgttcaccacgatgagcttgtcatcagcggatggcacaccaagcgacttaccgaacaatttgcacatgttctgcagcagttgattgccttgcctaagaacagcacgagcaagctcgaagatttggaggtcgtaagccccgaggacaaggctgaaattggtacatggaacgagcgcattcccctcacagtggaacgaaccgtccaagatttcattcgtgagaagtccgaggagactccgaatgcccaggctgtatgtgcctgggatggcgacatcacctacagagaattctggaacctggcctctggctttgccaactaccttgtctctcgcggagttggcccagaagtgtttgttccggtctgtctggacaagtcagcttgggcaatggtcacccttatcagtattctcatcgccggtggtgggtacgtacctttggatccctcccaccctacctcgcgacacgaggaaatccttgccgacgtcggtgccaacatgatactatgcacccccaactatacaaaccgctacagtcgggttgtgaagactgttatccccatcagcaaggagacgatcaaggcctatggcgcactcaagtcatcttcccgtcgccgaactgacgtcaaacccaccaacatggcttatgctctattcacctctgggagcactggtcgggccaagggaattattgtcgagcaccgcaatgtggtcagcagcatcatggcattcgccccgtgggtacgcatggatgagacatcgagagtattccaattcgcctccctcacttttgatgctgctgttatggagactcttgcgattctcatgctcggaggtaccatatgtgtgcccagcgaagatgaccgtctcaacgatgttgcgggcgcaattcgtcgactcaatgtcacttggacgttcctcaccccttcgattgcaagcatcattgagccatcctcagtgccttctctcaagcacctcgtttgtggtggagagaagatgtctaatgaagtcatcaccaagtgggccaattctgttcacctcatgaatgggtacggaccgaccgagacctgtgtctttgctgtgatcgacaatgcagtggccactaaccgtgatcccgggcgtatcggttacggtattcccagcactctcacttggattgttgaccccgacaaccatgatcggctgactcctctgggcgcagtcggtgaacttgcacttgaaggtgctccgttggccagagagtacctcaaaaaccccgagaaaaacgcagaagcattcacttcggaccctgcctggatcaaggacttcacccctgcgatcccgggtcctcgccgaatctacaagactggcgatctttgctactacaaccctgacggatcaattcagtacatcagccggaaggatcaccaggtcaaattgcatggccagcggatggagcttggtgagatcgagcatcgcctctctgaagatgctcttacccgccacgctgtcgtcgtgctccccaagaacggcccgcttaagcagcgcctggtcactgtgatgtctttgaacagtgtggcagctgataccaagcttatttctgacaagccctgtgagcttgttgacgagaatgagcttgagcgccacgcttacaacgagctggtcgaagtgcagaagaatcttgagaaccagctgcccatttacatggttccgcagacttgggctctcattaagaagcttcccatgctcgtttcgggaaagctcgaccggaagaagatcactgcttgggttgaggatattgatgatgcatcctacgagcgtatcatggccgattacgatcgcatcaagcgtggcaagatcgaggagaagccgcaagaaaaggaagagaagcatggatcgctcagcattatccgcgagatctttgcacaagtgttgaatatctccctacagaaggtcaacgtcgatcgctcctttgtcagcttgggcggcgacagcatcactggaatggctgtcatttctcgcgctcgcaaacaaggacttgtcgtgacactacacgacattctgcagagcagatcactgaaggaacttgctcaaactgccagctccaaggcgcctgtttcacagcgcgaagagaagtctggtgatggtttcgcactctctcctgtccaaaggctctacttccagagctcggactcgttcaagggcgccgctcgcttcaaccaaagcatgactgttcgcatcgctcgtcgttgtgagggtgaggtcctcaagcgcgccgtcaaggctgttattggccagcatgccatgttccgcgcgcgcttcagcacatctagtgacggcacttggcaacagaaaactgcagcggtaggctccctacaaatccctgatcgaacattttctaactcaacctcacaggaggtcgatgaatctttccaattccgcgttcactctgtggccgatatccgtgggatggttccaaagattgctgagagtcaaaattgtctcgatcctctcaatggacctattcttgcagccgacttgtttaaccttcgcaccggtggtcaggtcttattcctcgtcgctcaccatctctgcattgacatggtatcatggcgcatcgtgctccaggacctcgaagagctcgttgtctctggatctctttcactcgacaaagcattgtccttccaaagctggtgtgccatgcagacggagagagccaagatacaggatgcgactatttctctgcctttcactcctgagaagccgagcttgctttactggggcatgcaaggttcacccaatgtttacggagacatcaagatggaatccttcatgttgagtgaggatactaccaaattcatcctggatggctgccacagtgtcttccggactgacactgtcgacattttgctgtctgccatcatttattccttcggtcgcaccttcactgatcgcagggtgccaactatttacaacgaaggacatggcagagaagcctgggaagccgacattgatctttccagaacagttggctggtttaccacaatggcccctttgctagtggactccgaagctcgtgccctcaacgacattatcaagcgtgtgaaggacaccaggaggaagatcgcagacaatgggcgtccttacttcgccaaaaacctgcttcaagaccagggttccgatttccctgtcccgttagaaatcctgttcaattacctgggtaagatgcagcaacttgagcgagctgattcgctattccatcaccatggtagcgtctttgacagctcggactttgctgtcgcaggtgacatgggcccccagactgctcgtttcgccctcttcgaggtatccgccattgtcatcaaagaacgccttaatgttgctttcacctacaacaacaaaatgcagcatcagggctctattcgccgctggattctccaatgcaagcagaccctcgataaggatatcctcaccctcaaaacggccactccagagcccactctcagcgactaccccctcctcccaattaactatcacggcctccagatgctcactgccagcaccttccgcaaggccggcattcggaacaaggacgacgtcgaggacatatatccctgctctccgatgcaggagggactcttgctcagccagctccgcgatcccaatgcgtacatgttccatactgtgtttgagatcaaggatggcaaatctggcaaggtcgacgctgagggagttgcccgcgcttggcaggccctcgtcgaccgtcatcctgtgctccgaactattttcgtcgacagcaactacacgggcggatccttcgatcaactggtgctcaagaatctttccgacaatatcttacgcgtgcaatgccaggactcacaggttgaggagaagctggctgccatttccctccgtgacaggaacgcaatgcgccaagcgaagctttctcatcaattgacagtttgcaaaacgaacaccggacgtgtaattctcaagctggagatgaaccatgccatcatcgacggtggctcggtggatgtactcctccgtgacctgactctcgcctacgagcgaaaaattgccgagggttcaggacctctcttcagcgactacatcaaactcatcaggactcaaagccatagtgacgcactcagtcactggaaggaatacctcggcggagttcacccatgtcacctcgccccatcggctgtgttcgaagccaagagggaactaaagggtgtcaagatgaacttccagcgattccctgagttgcttaaattctgcgagcgaagctcggtgactctcgctaacttaaccctttccgcttgggccatcgttttgcgacagttcgttgggtccgatgacgtttgtttcggatatctctctgccggtcgcgatgcccctgtcgatggcattcaggacatggttggaatctttattaacatgctttgctgccgagtccagttctccgatcagcagaccctgacggatgtgtccaagagtgttcaggatgattatattcgatgcattccccaccaaagctgctctttggcgagcattcagcatgagcttggttggcagggacagtccctcttcaatactaccttgtcgatccagaaccactccgttgcgggtggtcccaaggacaagggactgtccttcgatcttcaacatgcacatgacccgagcgagtacgcggtcactgtgaacgttgagattgcgcgaggccaggagggtattcttttgagatactggaatgatattgtgtctgacgaggaggcacagagcctggctgacaccatcgccaaggtgttcactggctttattgagtccccggctgcgactctgtcgcagtccacattcgcttctgaggctgaacctgagtcggtggattgggatcgctcccaaaccacactggctgacaaggcaaagtcgaccggagaggctattgacagcagtgctatgcagaaaattattgatgatcgtgttcatgagattattgggcagatgttgagagaaggaaaactgacggtgcctcccattcgcacagaagggttgtcaagctatggcggtcacactgataccatagccgactcaccgtaccagttaggtatacaaggagcagatgattcgggtgtttgttcggcgacttcccgttccagcgaggatgggatgtcggtcgatgtggaaaggaaattgtggaatctttggagcacagctcttggcctctcacctaacgtggtgagacaccaggacagcttcttcaagttgggcggtgacagcatcaccgccatgaagatggtcagtgccgctcgtgaagagggcctggtccttactgttgcagatgtcttcaacaatcctgtcttcgaggacatgttgacaacggtgcgagccgccaatgtcactcagcagatgctgaatgccgatctcaagtcaggcggccacaaggaggttgacagtgatttactcaatatcaccccaacgacactggggcccagcccctctaccgagagcctcgaggttctcaagccatcgtgtgtcgatgatgccgcggtgcagcgcggtatctgtcccaaggttggtgtattcaagggtggcatcgccgatgtcctccctgtcactgacttccaggcgatgtctctgacggcgactctcttcaagtctcgatggatgcttaactacttctatcttgagggcaacggtcccctggacctgagacgccttcgcgagagttgcttgaaggttgtcgctgcatttgatattctgcgcacagtctttgtgtgcttccatgaccagttcttccaggtcgtgctgcgcaagatccgtcccagcatcttcgtttatgagacggaccgcgctcttgatgaattcaccatgacccttcaacagagagatcgtgaatacggaccgcgcgagggcgagcagtacgtgcagttctacgttgtcaagaagaagaacagcgaccagcaccgtatcatgatccgcctctctcacactcagtacgatggagtgtgcttgccaaagatcatggctgccattaagcacggatatgaaggcaccccactgcctccggttacccccttcgctggttacttgcgacagttgccaggaacaatcaccccggaccattaccgccactggacggaccttctcaagggctctcatatgacccaagttgtccgcagacgcggtaccagcatgttccagaacgttggagcattcaccgagatccacagaaagattgagatctcgcccactgccctcggaaatgtcactatcgcaactgtcatgcaggctgcctgggccctggcccttgccaagctctctgctcagtctgatgttatctttggcctgactatcagcggccgcaacgccacagtgcccggtatcgagagcaccgttgggccctgtgtcaatgtcatcccggtccgcgtgaagttcgatgagaaatggaccggtgtcgatctattccgctacctccaggaccaacaggtctccaacatgcctttcgagtccctgggcttccgcgagatcatcaagcaatgtaccgactggcccgactggacctacttcaccacctcagtcttccaccagaacgtcgactacgaaggaaacatgcagctcgacaacaacaagtaccgcatgggtggtgtcggcgtcaatgacaacctagccgatctcaccatggtatcccgtccttccggcgaacgaggcctcgatgtcaccctcggctactccgaaaagggccctgtgatgccatcgttcgcatccaaggttctcgacatggcctgtgagattgcgcaatccctcgtcgccaacccaaccgcctccctgccctccgccagcatgctacgctccctgccaccgcagacaatcgacgatcaaccccgaccaacagacgagcacttcctcagcgcgcacctcaagtcgcgctccatcgcagagctgctcgtgcattcagacattctgtctcgctcgtggcaccaggtcctgcccagtcgcaccacgaccggccccgtcgacccagaagcggacaaacccacccaccaatccgccttccagttggactcgtccttctttgatctcggcggtgacgtcttcaatttagcccagcttacctggctcctggagcaagagggtctcaaggttcgtctggaggatcttattgagcacccctctttcctgggccaaatggccgtgctggctttgcataacgccaagcaccaggaggatatgccaacggagcttcttgctaccggtgctgcaccgcctgatcctgtcgctcgcattgaaaagaagaagacatggtccaaggccatgaccatagcgagaaagttgactgggcgaaacacggtcaccagtcgagcttga

SEQ ID NO: 33 - RNA, 18195 nt, Penicillium chrysogenum
auggcucaauccaccaagugcuaucuuccucgguucgcuucgacgguugacgggccuaaacgcccagucucgaugaagacgagacccacggcugcucagcaugcgcaguuauuaaccgcauggaacgaaggccgucuggaccccauccuacgagccaccugggcucucuuguugcacuacuauauccgcuccgaggauauaugcuucgguuaccaacaucucgagggcgacucgcgcucucccaaaucaucuguacagcguucuaccgucaacauuucgacgauccgcauauccaucaacgacaacgacucucucaaagcaauuguagauaaggugcgcgcaaacagugcgauucgccagaacaauggaagccccgaggcuuccgaggcauaucuuccuuucaacaccaucuucaugcugcgcacauacgacccgccugcuucuccuucaaaaccuauucuggcgacagcuauuccggacgagugucaaguccgucuucaugucaaggugcugcguggagacaucagcaucuuccucgaauggcgcaagggugacauguccggggaacagaugaagaguaucgcaaacauuuuugagcaguugcuugccaaagugcuuucugccgagaacaccgcuauuagccagcuuaauuuguucucggagaacgacuggcaacgcauccgcaaguggaauuccacuacuccacagcuucacgaucgcugcauucacgaggccauccacgaucaaauguugagcggaccugaucgugaggcugugugugcgugggauggaaguuugacguucgccgaguuggaucaccaagcgucgaagcuugcaugcuaucuucgcaugcagggagucgggccggaaauccgcguggcuuuguguuuugauaaaucgaaauggaauaucguugcaaugcuuggcgugaugaaagccgggggagccuucgucccauuggacccaagucacccaacuucccgacugcaaggucucauccaaucgguugaggcaccgguugugcugugcucucagcaucuugccgauaaacuucguccgaucguaaagacuuuaauaccccucugugcugauacucucgauccucugucggaccccaccgacagugucaaucuugcaucuggugucacaagucaaaaugcggcuuauguucuguuuaccucuggaucaacaggagaacccaaggggacucucuuggagcaccgcgcguuccuguccggggcgauggugcauggacccgggcugcgcauuuaucgcgacucgcgaugccuucaauuugccgcccacacauucgaugcuaguuuagccgagacauugacgccgcucauucauggugcgugcgugugcauuccgagcgaggaagcucggcucaacgauauugugagcaccaucaacgagaugcgagucacccaagcuugcuucaccccgucauucaucggcuuuauugaaaucgagagcguuccaggacuggagaguuugguccuggccggggaggcaaugucgcagucacagcugacuaccugguccaaaaucaaacuggucaaugguuauggaccuaccgaggccagcguggcguccguccucaacuccaauguuacaccugacaccgauugcaaagauaucggacugccuauugguguaagagcuuggcuggugaacccugauaaccacgaugaacugguccccgugggcugcccuggagaacuacuuuuggaaggcccaccccuggcccggugcuacgugaauaauccccaaaagacaaacgaaucauucaucuacgacccugcuuggacuacauuggacccugaaacuggcucgaaucguagauucuacaagacaggugaucucgccagguacaacuccgacacuggugcccugaacuacgucggucgcaaggauacacaggucaagguucacggacaacggaucgagcucggcgaaauugagaaucagcucagcaaagauucgaacgucacucauugcucugucuuuuuccccaagacuggguuuuccaagggacgccuggcggcaguugugucguccacugguuugcuugcggaacagucugauucggacuuggaaccucuacgacuaguccccgccucgaaaaaggcugagcuugucccuggcauccgagagcgucuaucagcucgccuccccacuuacauggucccugcggugugguugugugucgaagcucugccacuucugccaucagggaagcuagaccgcaagggcauuuccacuugggucgccgguauggagagcgauccggaucuucagaacgguaccuccgcugcaauugucgacgcagaagccucacagcccgccaacgacagagaggaagcuuuagccgcuguauauagccguguccucaacauuccccagaaccagcucaauuugaaugagagcuuccucgcccucgguggugauucgaucgcagcuaugacauguaucggucuauguaagaagcgaggguuugcccucucuguacaggagcuacuucggagcaaaucaauccgcgaccucgcaacucgcgcaaagacgauugaucaccuuacgacuuacgaagaagcuguugacgaaccguucagccugucccccauccagagccuucacuucgguguacgcaaggagggccaaggccacuucaaucaaggaauccugacucgcuugaauaaacccgucgacgaaaggacccuccgcaaggcugucgaaacgcugguaucucggcacuccaugcuccgugcacgauucacugacacagguuucgcgacggcguccagucaacacauuacucgcgauaucaagggaucuuacagauggcgaaugcacacucuugccaacaugaacgaggucgaaacucaugucgccgacagccaauccucuaucaacugcuuuucugggccacugcuggcaguggauuauuucuuggugaagggccggccuaauguccugucaaugacagcucaucacuuggucgucgacauugucucuuggagaauuauucuggaagauuuggaagacaucauucuaaaccccgagaagacuggaaccagugaugguucguugccuuuccagaccuggugccgccugcagaaugagcacugcaacacccuacgugcugagcacaaaguugcaacugaugcucucgcuguacccgacuuugguuacugggggcucaaagacacucaaacuacuuauggagauguggauugugccucguuugagaucgacccagcucauaccaaugcuauucugcuggaaugucacaaagcucuuggcaccgagccaauugacuuauuccuggcagcaaugcuccacucauuuggccgcgcuuuccccgaucguucucuuccaacgaucuacaaugaaggccacggacgcgaagucugggacccguccauugauauuucgcauacuguuggcugguucaccauucugcacccaaucuuugucucagcauacaagucagacagccccauugauacccucauccagguuaaggaucuucgccgucgcgucacggacaauggccgcgcagauuucaccagccguguacucccagcucagggcaaucaaggguccaagcacccucaucccuucgagaugucauucaacuacguuggacaacaccgagaucuacaaaggaaggauggucucuuccaacuuguugaucagauggcaggagaagcugggcaaggaggcggcgccgcugacuucggaucagauacuccccgcuuuggucuguuugagaucucugcgauggucguggcugggaagguucgauucaacuucuccuuuaacaaguucaugcagcaccagaaucguauucaccgauggguuuccgaaugccaggagcugcuuguaacccucucugagcagcuuccgacccucgagccgcguuugacucucagcucguucccaaugcugucgcugaccuacccuaccuuggacaaguugcucaaugaaaaguugccugcuauggguauugaguccccugacuuuguugaggauaucuauccuuguucucgcaugcagcaggguauccuacuuggucgcaagcgagauagcuccuacuaugcuguccacgacaccuuugaaauucgggccacuggaucuggcaagccaaaccucgaucgccuggucaaugcauggcagaaggucguuucucaucaugcgauguuccgcacaaucuucguugagaaccucacuccucgcgaccccuucugccaggucguacugaagaguuaugaugcuacuccuguuuucuugcagucuucaggggaaaaggacgugcuggccacguuugacaaggaagaccccaaggauuacagcgagccugaaccagcguaucguuucucuauuugccagacacccacuggcagacuguuugcucgcauugagaucagucaugcggcgauggacgguaacuccaucuccaucauucuccgugacuuacagcucgcauaugcaggcagacucgaggaaagcccucagccuuuguucaaggauuauauccaguacaugcaggaugcgccgaacgaagcuagcaucagcuacuggcguucguacuuggaucaagcuaagccgugccacuuccccgcccucacugacggccaacagucagcaaaggcacuucggucuauuccugucaacuuuggggcccuagacgaacuccaaacugucugcgagaaacgcggaaucacucucgcaaaugucuucaaugccgcauggggccuuacucuccgcgcguucuguggauccgacgaugucuccuuuaguuacauggcuucccugcgugauguuucugcugacggcguccaguggguggucggaccaguuaucaaccuucuaaucugucgcaugaagguugccgaugaugcgaagcucagugaugugcuacaccaaauccagaacgacuacauggaaagccuuccuuaucgucacacuucgcucaucgagauccagcaugcuuugaagcuguccgacaccaauuuguucaauuccggugucuccuaccgccgucuucccaguucuaaggaugcugucagcagcgaaaucgagugugcugagguuggcucaauucacgaucccgccgaguucccgguauucaucaacaucgaggccauggauaccacggcucgcauugaccucaacuacuggacuacgaaucucucugauucacaggcugccaauguggccaauacauaccuucgaugccuugagaacguugugucgaacauugacugugaaauccgccagcuaaacaacuugagcgaggauaaccgugcccagaucauggcguggaacaguaagacucacaagcccuucgaaaagugcgcccaucacguuguccaagagauggccaagaagcgcucugaugccuuggcuguaacugcuugggaugggaacuugacuuacuccaaguuggaucaauucuccucccgauuggcaggcuaucuugucacuuucggugugggucccggcacacugauccccaucugcuucgagaagucuaucuggaacauagucuccacauuggcaaucaugaaagccggugguggcuguauuccaguugacacacccgagagucucgcugcuguugagaacuggauugucgacaacgccguccaagucgcucuggcuuccccggagaaggcucacguccucgaggaugccguaccguacgucaucccuguaagcgagucucuucucgaguaccucgcggacgaggaucucaaccccguggcacaaucaucagacgucgcauacgucgcuaugacugccgguaccuccggccccgcuaagagugucguccuugaccauucaacugucaugacccgagccgaggcauucgcuaccaccauggcaauugccgaugucuccaggacucugcaauucgcaccccauacauccgaugcauuuauugucgaggcauucgccacuuucauguggggugguugcauuugcauuccggcugacauugacccucucaacuuggcugccuguaucaaugcgcuccauguuaaugucgcgagcaucaccccgacagccgcaagcuucuucucccccaaggauguuccgggccugcgaucgaucgcccucggcggcgaaguugugccccagagcgugcucgaccacuggaagaccgacgaccuccaauugcagguuuuguauggaacaugcgagagcucagcggccuccuuccauguguucuguucucaggaggagcacgaggcugcgcucauuggaaagagcacguccuguguuucaugggugguugaccccuccaaccacgagaaccuuguuccgaucggcucugugggagaauuggcccucgagggcccuguuauugccucgggcuaccucgacgaccagucuguagagaccagugacuuuuucgagaacgcuccuuggcuuucuggacaacgaggagggcguaaacaccgucuuuucaagaccggggaucuuguucgguacaaauccgauggcucccucguuuucgucggccgaaagaaugauaagagucaauccgccuuggcuagcgagcuuauccagacucagacgcgcaucgauacauuccuggaaaagaagaaguguguuguggaaagcguccagcugcaacguggcgacaugaagacaaaugcccuuguugcuuucguggucuucucggacaccaucccagucacuuauggggaccgcguccuccaguccgcaacgcccggaaugaaagaugccaugucuagcuugcacgcuagucugaguaccagucuuccugguagcaagguuccgaguuucuacauccccauuuccucccuccccuugaccgucucuggaaagcuaaaccgccaggcccucaaauucgaaacacaagcgcucucgagcagugcucucgaggcuuucgacauuaagcauuggaacggauccaagacugguaaccgggcugcacggcaggccagucucuccgggcccaacaucgcuuucuggaaggaguaucucgccgacguugagcccugcauuuucccggcgcucucccaugaagcaagcgccaaugcccgcuccauucgcacgcucaacaagcagucagccaacauccaugccuucagcagauugucuggccugccuguagaaacucucuuccaguucgccugggcgguuguucuccggugguacacuggcucagacgauguuugcuuuggauauuccgccgcagccuccgagacgaaaucggaggccgauggaguuuccaccugccguuuccucguacagaacgagcaaaagcugcaggagacucuccaaaaagcaaagagggacugugagaccagugcauugaaugucgcucccuuggacgcagucaagcaccagcuuggacucgauaacacaacgcucuucaacaccucccugauuuaccgcacggcuuccaaucuccccaagggaaguacccgggagccaagcaccucuagugcuuacaagaucuugguugaagcugaagucucgcauucguacgccgagauacacuucaccuacuccucagacacccuuuccuccuuccaggucagccaugucauggacauguuugaccaagucuuggacgauuugauagcccacaaccuccgugaccgcaccauaggggacgucaauguacucccugaacgcucaguucgucgaauccgcgauuggaaugccgcauccccuccuagaguggagaaaugcgccgacgaacucauccagcagcaggcccuccuccacccccgcgccgaagccgucugcucuugggacaagaauuucaccuaugggcaacuugaaauuguguccagucgccuggcucgucaucucuccagccuuggagucaagcccgaagccuuugugguguugugcuucgagaagucagcuugggcuguaguggcccagcuggcuguucucaaggcggguggagccuucgucucgauugacccaucccaccccgauucucgacugaagaugcuuaucgaugaaauuggcacuaaccuugucuugugcucguccucaguccacaccaagguuucgaaacugugcacuaaaucauucgccgucugccagacuucaaucucccaacuuccugauucgccuuuggcucugcccggugcucguccuacuccaaacaaugcugcauaugcuauauuuaccucugguacuacuggaaagcccaaggcaacugucgucgaacauacugcccuuagcaccaccgcgaucgccaugaucgacggccugcacaugaacuccacaacccgugcuuugcaguucucuaacuacaccuuugacguuagcaucuuggagaucaugaugauucucaugacugguggcugugucuguauucccagcgaggaugagcggaugaacaacuuggguggugccauccgccgaauggaagccaccuacaucucggcaccuccugccauugucaauacacuagagccgaaaaacgucccuagccucaaggucauuaucacaggcggcgagaagaugcccgccaaccauauugaccgcugggcagaccggugugucaucaaugccuauggucccuccgaggcgacagucguugcuacaguuggugucaagguugauugggauggaaaccgugucaacgaugaccccacaucuauuggaacaucuccaaauugcagagucuggauugucgauccgaacaacuccaaccgucugcugcccguuggcgcugucggugagcugauccuugaaggaagcaacauugcccguggauaccuugccaacgaggaaaagacgaaggccucuuucuucgagaauccuguguggaaccgucauuccggcuuacagggcguguucaagcggaacgaucgcauguaccguacuggugaucuuguucgcuacaacagugauggcagucuggcuuucaucucccgcaaagacacucagaucaaguucaacggccagcgaauugaacuggaggagauugaacaacaauguauccgcugccuaccugaagauucucagguugcuguugacgucguuguccccgaggaacggaccaucgccaagggucucgccgcauucuucacgguucaugacccagauuccaacggcggcagcaacgaucaauuugcccccacgguuccuggagccgauccacugcuccugccuaucuccauguccaacauggaugccauucagaaguugaagggcucucugcccgaacuccuaccucagagcaugaugccucgacucuucuucccuauccgcaacuugcccuucacuuccucgggaaagauugaccgccgaagauugcgggccaugguacaaaccuuauccaaggauacucuuaagucuuacauuacccucaccaccuccgacagacgggagauuuccucagcuaccggccucgagaucaagcugguggcccuugucgaaaagacccucgagcuugaagcuggaucugugaccgucgaugacagcuucuucggucuggguggugauuccuuguccgccaugaaccucgucggcgcugcucaagcagaaggcaucgcacucaccgucucgggcaucuucaauuccccgauauugguugacauggccaagagcugcgucgugucugacggcccugcugaaguuaagaaagaagauaucaaggcauucucauugcugcccucuggagucuaccucgaaaaucugauggaugaagucaccgacagcugcgaaguguccaaggaccuuaucagcgauauuuacccaugcagcgcugugcaggagggucuucucacgcucucuaucaagcauaacggugcuuauguugcucagcccucguuccgucuugcugcuggcauugaugucgguaaauucaaacaggccuggcagcaaacggugucagacuuggaaauccuucgcacucgcauuguccacacugaagcuaugaacuuugcucaaguuguccucaaggauggccccaucuccugggucgaagcagagucguucgauucucugcccaacgauuuccuucaccuucccaagcaaaauggagcagcucucacugguuacgccauggugcauccccguggcucgucugacagcuacuuuguguggucuguucaccacgcccuuuaugacggcuggaguauuccucugguauuccgcaaggucgaagagaacuacuuuuccucacagcccaagcgcgcuggcaccccuuacagucuguucaucgacuaucuggcuaagaaggauauggaggagucugaugcuuucuggaagucuuaccugacugaucuguccagcacuccuuucccucauaacaagaacgcuguuccugaugccaugcgugcuggcaacacccaguaucacaacaugaaacuuucccgcacccgcaacagcgucgacuuuacgauccccguccucaugcgcgcugcaugggcaauugucauugcuacacacacugccuccggugaugugugcuucggcgagacucugucggguagaaauaucgaucuccccgguguugcagauauugcugguccuguucugaccacuguccccacccgaguccagguugacaaugcuauguccacuaugcaguacuugcagaagauccaccagucgaccaccgagaugaucccacauuugcacucuggucuucagcguauccggcaacugaacaaggauaccuccgaggguugcaauuuccaaaacuugcuugugauccagccaggcgauggcgaacucgacaacaagaucuggaucgacgagaaacgugaaacaagcgaagacuucuucacucacccccuuguuguggaauguggaaucacgaagacaagcaucuccuucaccguucaccacgaugagcuugucaucagcggauggcacaccaagcgacuuaccgaacaauuugcacauguucugcagcaguugauugccuugccuaagaacagcacgagcaagcucgaagauuuggaggucguaagccccgaggacaaggcugaaauugguacauggaacgagcgcauuccccucacaguggaacgaaccguccaagauuucauucgugagaaguccgaggagacuccgaaugcccaggcuguaugugccugggauggcgacaucaccuacagagaauucuggaaccuggccucuggcuuugccaacuaccuugucucucgcggaguuggcccagaaguguuuguuccggucugucuggacaagucagcuugggcaauggucacccuuaucaguauucucaucgccggugguggguacguaccuuuggaucccucccacccuaccucgcgacacgaggaaauccuugccgacgucggugccaacaugauacuaugcacccccaacuauacaaaccgcuacagucggguugugaagacuguuauccccaucagcaaggagacgaucaaggccuauggcgcacucaagucaucuucccgucgccgaacugacgucaaacccaccaacauggcuuaugcucuauucaccucugggagcacuggucgggccaagggaauuauugucgagcaccgcaauguggucagcagcaucauggcauucgccccguggguacgcauggaugagacaucgagaguauuccaauucgccucccucacuuuugaugcugcuguuauggagacucuugcgauucucaugcucggagguaccauaugugugcccagcgaagaugaccgucucaacgauguugcgggcgcaauucgucgacucaaugucacuuggacguuccucaccccuucgauugcaagcaucauugagccauccucagugccuucucucaagcaccucguuugugguggagagaagaugucuaaugaagucaucaccaagugggccaauucuguucaccucaugaauggguacggaccgaccgagaccugugucuuugcugugaucgacaaugcaguggccacuaaccgugaucccgggcguaucgguuacgguauucccagcacucucacuuggauuguugaccccgacaaccaugaucggcugacuccucugggcgcagucggugaacuugcacuugaaggugcuccguuggccagagaguaccucaaaaaccccgagaaaaacgcagaagcauucacuucggacccugccuggaucaaggacuucaccccugcgaucccggguccucgccgaaucuacaagacuggcgaucuuugcuacuacaacccugacggaucaauucaguacaucagccggaaggaucaccaggucaaauugcauggccagcggauggagcuuggugagaucgagcaucgccucucugaagaugcucuuacccgccacgcugucgucgugcuccccaagaacggcccgcuuaagcagcgccuggucacugugaugucuuugaacaguguggcagcugauaccaagcuuauuucugacaagcccugugagcuuguugacgagaaugagcuugagcgccacgcuuacaacgagcuggucgaagugcagaagaaucuugagaaccagcugcccauuuacaugguuccgcagacuugggcucucauuaagaagcuucccaugcucguuucgggaaagcucgaccggaagaagaucacugcuuggguugaggauauugaugaugcauccuacgagcguaucauggccgauuacgaucgcaucaagcguggcaagaucgaggagaagccgcaagaaaaggaagagaagcauggaucgcucagcauuauccgcgagaucuuugcacaaguguugaauaucucccuacagaaggucaacgucgaucgcuccuuugucagcuugggcggcgacagcaucacuggaauggcugucauuucucgcgcucgcaaacaaggacuugucgugacacuacacgacauucugcagagcagaucacugaaggaacuugcucaaacugccagcuccaaggcgccuguuucacagcgcgaagagaagucuggugaugguuucgcacucucuccuguccaaaggcucuacuuccagagcucggacucguucaagggcgccgcucgcuucaaccaaagcaugacuguucgcaucgcucgucguugugagggugagguccucaagcgcgccgucaaggcuguuauuggccagcaugccauguuccgcgcgcgcuucagcacaucuagugacggcacuuggcaacagaaaacugcagcgguaggcucccuacaaaucccugaucgaacauuuucuaacucaaccucacaggaggucgaugaaucuuuccaauuccgcguucacucuguggccgauauccgugggaugguuccaaagauugcugagagucaaaauugucucgauccucucaauggaccuauucuugcagccgacuuguuuaaccuucgcaccgguggucaggucuuauuccucgucgcucaccaucucugcauugacaugguaucauggcgcaucgugcuccaggaccucgaagagcucguugucucuggaucucuuucacucgacaaagcauuguccuuccaaagcuggugugccaugcagacggagagagccaagauacaggaugcgacuauuucucugccuuucacuccugagaagccgagcuugcuuuacuggggcaugcaagguucacccaauguuuacggagacaucaagauggaauccuucauguugagugaggauacuaccaaauucauccuggauggcugccacagugucuuccggacugacacugucgacauuuugcugucugccaucauuuauuccuucggucgcaccuucacugaucgcagggugccaacuauuuacaacgaaggacauggcagagaagccugggaagccgacauugaucuuuccagaacaguuggcugguuuaccacaauggccccuuugcuaguggacuccgaagcucgugcccucaacgacauuaucaagcgugugaaggacaccaggaggaagaucgcagacaaugggcguccuuacuucgccaaaaaccugcuucaagaccaggguuccgauuucccugucccguuagaaauccuguucaauuaccuggguaagaugcagcaacuugagcgagcugauucgcuauuccaucaccaugguagcgucuuugacagcucggacuuugcugucgcaggugacaugggcccccagacugcucguuucgcccucuucgagguauccgccauugucaucaaagaacgccuuaauguugcuuucaccuacaacaacaaaaugcagcaucagggcucuauucgccgcuggauucuccaaugcaagcagacccucgauaaggauauccucacccucaaaacggccacuccagagcccacucucagcgacuacccccuccucccaauuaacuaucacggccuccagaugcucacugccagcaccuuccgcaaggccggcauucggaacaaggacgacgucgaggacauauaucccugcucuccgaugcaggagggacucuugcucagccagcuccgcgaucccaaugcguacauguuccauacuguguuugagaucaaggauggcaaaucuggcaaggucgacgcugagggaguugcccgcgcuuggcaggcccucgucgaccgucauccugugcuccgaacuauuuucgucgacagcaacuacacgggcggauccuucgaucaacuggugcucaagaaucuuuccgacaauaucuuacgcgugcaaugccaggacucacagguugaggagaagcuggcugccauuucccuccgugacaggaacgcaaugcgccaagcgaagcuuucucaucaauugacaguuugcaaaacgaacaccggacguguaauucucaagcuggagaugaaccaugccaucaucgacgguggcucgguggauguacuccuccgugaccugacucucgccuacgagcgaaaaauugccgaggguucaggaccucucuucagcgacuacaucaaacucaucaggacucaaagccauagugacgcacucagucacuggaaggaauaccucggcggaguucacccaugucaccucgccccaucggcuguguucgaagccaagagggaacuaaagggugucaagaugaacuuccagcgauucccugaguugcuuaaauucugcgagcgaagcucggugacucucgcuaacuuaacccuuuccgcuugggccaucguuuugcgacaguucguuggguccgaugacguuuguuucggauaucucucugccggucgcgaugccccugucgauggcauucaggacaugguuggaaucuuuauuaacaugcuuugcugccgaguccaguucuccgaucagcagacccugacggauguguccaagaguguucaggaugauuauauucgaugcauuccccaccaaagcugcucuuuggcgagcauucagcaugagcuugguuggcagggacagucccucuucaauacuaccuugucgauccagaaccacuccguugcggguggucccaaggacaagggacuguccuucgaucuucaacaugcacaugacccgagcgaguacgcggucacugugaacguugagauugcgcgaggccaggaggguauucuuuugagauacuggaaugauauugugucugacgaggaggcacagagccuggcugacaccaucgccaagguguucacuggcuuuauugaguccccggcugcgacucugucgcaguccacauucgcuucugaggcugaaccugagucgguggauugggaucgcucccaaaccacacuggcugacaaggcaaagucgaccggagaggcuauugacagcagugcuaugcagaaaauuauugaugaucguguucaugagauuauugggcagauguugagagaaggaaaacugacggugccucccauucgcacagaaggguugucaagcuauggcggucacacugauaccauagccgacucaccguaccaguuagguauacaaggagcagaugauucggguguuuguucggcgacuucccguuccagcgaggaugggaugucggucgauguggaaaggaaauuguggaaucuuuggagcacagcucuuggccucucaccuaacguggugagacaccaggacagcuucuucaaguugggcggugacagcaucaccgccaugaagauggucagugccgcucgugaagagggccugguccuuacuguugcagaugucuucaacaauccugucuucgaggacauguugacaacggugcgagccgccaaugucacucagcagaugcugaaugccgaucucaagucaggcggccacaaggagguugacagugauuuacucaauaucaccccaacgacacuggggcccagccccucuaccgagagccucgagguucucaagccaucgugugucgaugaugccgcggugcagcgcgguaucugucccaagguugguguauucaaggguggcaucgccgauguccucccugucacugacuuccaggcgaugucucugacggcgacucucuucaagucucgauggaugcuuaacuacuucuaucuugagggcaacgguccccuggaccugagacgccuucgcgagaguugcuugaagguugucgcugcauuugauauucugcgcacagucuuugugugcuuccaugaccaguucuuccaggucgugcugcgcaagauccgucccagcaucuucguuuaugagacggaccgcgcucuugaugaauucaccaugacccuucaacagagagaucgugaauacggaccgcgcgagggcgagcaguacgugcaguucuacguugucaagaagaagaacagcgaccagcaccguaucaugauccgccucucucacacucaguacgauggagugugcuugccaaagaucauggcugccauuaagcacggauaugaaggcaccccacugccuccgguuacccccuucgcugguuacuugcgacaguugccaggaacaaucaccccggaccauuaccgccacuggacggaccuucucaagggcucucauaugacccaaguuguccgcagacgcgguaccagcauguuccagaacguuggagcauucaccgagauccacagaaagauugagaucucgcccacugcccucggaaaugucacuaucgcaacugucaugcaggcugccugggcccuggcccuugccaagcucucugcucagucugauguuaucuuuggccugacuaucagcggccgcaacgccacagugcccgguaucgagagcaccguugggcccugugucaaugucaucccgguccgcgugaaguucgaugagaaauggaccggugucgaucuauuccgcuaccuccaggaccaacaggucuccaacaugccuuucgagucccugggcuuccgcgagaucaucaagcaauguaccgacuggcccgacuggaccuacuucaccaccucagucuuccaccagaacgucgacuacgaaggaaacaugcagcucgacaacaacaaguaccgcauggguggugucggcgucaaugacaaccuagccgaucucaccaugguaucccguccuuccggcgaacgaggccucgaugucacccucggcuacuccgaaaagggcccugugaugccaucguucgcauccaagguucucgacauggccugugagauugcgcaaucccucgucgccaacccaaccgccucccugcccuccgccagcaugcuacgcucccugccaccgcagacaaucgacgaucaaccccgaccaacagacgagcacuuccucagcgcgcaccucaagucgcgcuccaucgcagagcugcucgugcauucagacauucugucucgcucguggcaccagguccugcccagucgcaccacgaccggccccgucgacccagaagcggacaaacccacccaccaauccgccuuccaguuggacucguccuucuuugaucucggcggugacgucuucaauuuagcccagcuuaccuggcuccuggagcaagagggucucaagguucgucuggaggaucuuauugagcaccccucuuuccugggccaaauggccgugcuggcuuugcauaacgccaagcaccaggaggauaugccaacggagcuucuugcuaccggugcugcaccgccugauccugucgcucgcauugaaaagaagaagacaugguccaaggccaugaccauagcgagaaaguugacugggcgaaacacggucaccagucgagcuuga

SEQ ID NO: 34 - protein, 6064 aa, Penicillium chrysogenum
MAQSTKCYLPRFASTVDGPKRPVSMKTRPTAAQHAQLLTAWNEGRLDPILRATWALLLHYYIRSEDICFGYQHLEGDSRSPKSSVQRSTVNISTIRISINDNDSLKAIVDKVRANSAIRQNNGSPEASEAYLPFNTIFMLRTYDPPASPSKPILATAIPDECQVRLHVKVLRGDISIFLEWRKGDMSGEQMKSIANIFEQLLAKVLSAENTAISQLNLFSENDWQRIRKWNSTTPQLHDRCIHEAIHDQMLSGPDREAVCAWDGSLTFAELDHQASKLACYLRMQGVGPEIRVALCFDKSKWNIVAMLGVMKAGGAFVPLDPSHPTSRLQGLIQSVEAPVVLCSQHLADKLRPIVKTLIPLCADTLDPLSDPTDSVNLASGVTSQNAAYVLFTSGSTGEPKGTLLEHRAFLSGAMVHGPGLRIYRDSRCLQFAAHTFDASLAETLTPLIHGACVCIPSEEARLNDIVSTINEMRVTQACFTPSFIGFIEIESVPGLESLVLAGEAMSQSQLTTWSKIKLVNGYGPTEASVASVLNSNVTPDTDCKDIGLPIGVRAWLVNPDNHDELVPVGCPGELLLEGPPLARCYVNNPQKTNESFIYDPAWTTLDPETGSNRRFYKTGDLARYNSDTGALNYVGRKDTQVKVHGQRIELGEIENQLSKDSNVTHCSVFFPKTGFSKGRLAAVVSSTGLLAEQSDSDLEPLRLVPASKKAELVPGIRERLSARLPTYMVPAVWLCVEALPLLPSGKLDRKGISTWVAGMESDPDLQNGTSAAIVDAEASQPANDREEALAAVYSRVLNIPQNQLNLNESFLALGGDSIAAMTCIGLCKKRGFALSVQELLRSKSIRDLATRAKTIDHLTTYEEAVDEPFSLSPIQSLHFGVRKEGQGHFNQGILTRLNKPVDERTLRKAVETLVSRHSMLRARFTDTGFATASSQHITRDIKGSYRWRMHTLANMNEVETHVADSQSSINCFSGPLLAVDYFLVKGRPNVLSMTAHHLVVDIVSWRIILEDLEDIILNPEKTGTSDGSLPFQTWCRLQNEHCNTLRAEHKVATDALAVPDFGYWGLKDTQTTYGDVDCASFEIDPAHTNAILLECHKALGTEPIDLFLAAMLHSFGRAFPDRSLPTIYNEGHGREVWDPSIDISHTVGWFTILHPIFVSAYKSDSPIDTLIQVKDLRRRVTDNGRADFTSRVLPAQGNQGSKHPHPFEMSFNYVGQHRDLQRKDGLFQLVDQMAGEAGQGGGAADFGSDTPRFGLFEISAMVVAGKVRFNFSFNKFMQHQNRIHRWVSECQELLVTLSEQLPTLEPRLTLSSFPMLSLTYPTLDKLLNEKLPAMGIESPDFVEDIYPCSRMQQGILLGRKRDSSYYAVHDTFEIRATGSGKPNLDRLVNAWQKVVSHHAMFRTIFVENLTPRDPFCQVVLKSYDATPVFLQSSGEKDVLATFDKEDPKDYSEPEPAYRFSICQTPTGRLFARIEISHAAMDGNSISIILRDLQLAYAGRLEESPQPLFKDYIQYMQDAPNEASISYWRSYLDQAKPCHFPALTDGQQSAKALRSIPVNFGALDELQTVCEKRGITLANVFNAAWGLTLRAFCGSDDVSFSYMASLRDVSADGVQWVVGPVINLLICRMKVADDAKLSDVLHQIQNDYMESLPYRHTSLIEIQHALKLSDTNLFNSGVSYRRLPSSKDAVSSEIECAEVGSIHDPAEFPVFINIEAMDTTARIDLNYWTTNLSDSQAANVANTYLRCLENVVSNIDCEIRQLNNLSEDNRAQIMAWNSKTHKPFEKCAHHVVQEMAKKRSDALAVTAWDGNLTYSKLDQFSSRLAGYLVTFGVGPGTLIPICFEKSIWNIVSTLAIMKAGGGCIPVDTPESLAAVENWIVDNAVQVALASPEKAHVLEDAVPYVIPVSESLLEYLADEDLNPVAQSSDVAYVAMTAGTSGPAKSVVLDHSTVMTRAEAFATTMAIADVSRTLQFAPHTSDAFIVEAFATFMWGGCICIPADIDPLNLAACINALHVNVASITPTAASFFSPKDVPGLRSIALGGEVVPQSVLDHWKTDDLQLQVLYGTCESSAASFHVFCSQEEHEAALIGKSTSCVSWVVDPSNHENLVPIGSVGELALEGPVIASGYLDDQSVETSDFFENAPWLSGQRGGRKHRLFKTGDLVRYKSDGSLVFVGRKNDKSQSALASELIQTQTRIDTFLEKKKCVVESVQLQRGDMKTNALVAFVVFSDTIPVTYGDRVLQSATPGMKDAMSSLHASLSTSLPGSKVPSFYIPISSLPLTVSGKLNRQALKFETQALSSSALEAFDIKHWNGSKTGNRAARQASLSGPNIAFWKEYLADVEPCIFPALSHEASANARSIRTLNKQSANIHAFSRLSGLPVETLFQFAWAVVLRWYTGSDDVCFGYSAAASETKSEADGVSTCRFLVQNEQKLQETLQKAKRDCETSALNVAPLDAVKHQLGLDNTTLFNTSLIYRTASNLPKGSTREPSTSSAYKILVEAEVSHSYAEIHFTYSSDTLSSFQVSHVMDMFDQVLDDLIAHNLRDRTIGDVNVLPERSVRRIRDWNAASPPRVEKCADELIQQQALLHPRAEAVCSWDKNFTYGQLEIVSSRLARHLSSLGVKPEAFVVLCFEKSAWAVVAQLAVLKAGGAFVSIDPSHPDSRLKMLIDEIGTNLVLCSSSVHTKVSKLCTKSFAVCQTSISQLPDSPLALPGARPTPNNAAYAIFTSGTTGKPKATVVEHTALSTTAIAMIDGLHMNSTTRALQFSNYTFDVSILEIMMILMTGGCVCIPSEDERMNNLGGAIRRMEATYISAPPAIVNTLEPKNVPSLKVIITGGEKMPANHIDRWADRCVINAYGPSEATVVATVGVKVDWDGNRVNDDPTSIGTSPNCRVWIVDPNNSNRLLPVGAVGELILEGSNIARGYLANEEKTKASFFENPVWNRHSGLQGVFKRNDRMYRTGDLVRYNSDGSLAFISRKDTQIKFNGQRIELEEIEQQCIRCLPEDSQVAVDVVVPEERTIAKGLAAFFTVHDPDSNGGSNDQFAPTVPGADPLLLPISMSNMDAIQKLKGSLPELLPQSMMPRLFFPIRNLPFTSSGKIDRRRLRAMVQTLSKDTLKSYITLTTSDRREISSATGLEIKLVALVEKTLELEAGSVTVDDSFFGLGGDSLSAMNLVGAAQAEGIALTVSGIFNSPILVDMAKSCVVSDGPAEVKKEDIKAFSLLPSGVYLENLMDEVTDSCEVSKDLISDIYPCSAVQEGLLTLSIKHNGAYVAQPSFRLAAGIDVGKFKQAWQQTVSDLEILRTRIVHTEAMNFAQVVLKDGPISWVEAESFDSLPNDFLHLPKQNGAALTGYAMVHPRGSSDSYFVWSVHHALYDGWSIPLVFRKVEENYFSSQPKRAGTPYSLFIDYLAKKDMEESDAFWKSYLTDLSSTPFPHNKNAVPDAMRAGNTQYHNMKLSRTRNSVDFTIPVLMRAAWAIVIATHTASGDVCFGETLSGRNIDLPGVADIAGPVLTTVPTRVQVDNAMSTMQYLQKIHQSTTEMIPHLHSGLQRIRQLNKDTSEGCNFQNLLVIQPGDGELDNKIWIDEKRETSEDFFTHPLVVECGITKTSISFTVHHDELVISGWHTKRLTEQFAHVLQQLIALPKNSTSKLEDLEVVSPEDKAEIGTWNERIPLTVERTVQDFIREKSEETPNAQAVCAWDGDITYREFWNLASGFANYLVSRGVGPEVFVPVCLDKSAWAMVTLISILIAGGGYVPLDPSHPTSRHEEILADVGANMILCTPNYTNRYSRVVKTVIPISKETIKAYGALKSSSRRRTDVKPTNMAYALFTSGSTGRAKGIIVEHRNVVSSIMAFAPWVRMDETSRVFQFASLTFDAAVMETLAILMLGGTICVPSEDDRLNDVAGAIRRLNVTWTFLTPSIASIIEPSSVPSLKHLVCGGEKMSNEVITKWANSVHLMNGYGPTETCVFAVIDNAVATNRDPGRIGYGIPSTLTWIVDPDNHDRLTPLGAVGELALEGAPLAREYLKNPEKNAEAFTSDPAWIKDFTPAIPGPRRIYKTGDLCYYNPDGSIQYISRKDHQVKLHGQRMELGEIEHRLSEDALTRHAVVVLPKNGPLKQRLVTVMSLNSVAADTKLISDKPCELVDENELERHAYNELVEVQKNLENQLPIYMVPQTWALIKKLPMLVSGKLDRKKITAWVEDIDDASYERIMADYDRIKRGKIEEKPQEKEEKHGSLSIIREIFAQVLNISLQKVNVDRSFVSLGGDSITGMAVISRARKQGLVVTLHDILQSRSLKELAQTASSKAPVSQREEKSGDGFALSPVQRLYFQSSDSFKGAARFNQSMTVRIARRCEGEVLKRAVKAVIGQHAMFRARFSTSSDGTWQQKTAAVGSLQIPDRTFSNSTSQEVDESFQFRVHSVADIRGMVPKIAESQNCLDPLNGPILAADLFNLRTGGQVLFLVAHHLCIDMVSWRIVLQDLEELVVSGSLSLDKALSFQSWCAMQTERAKIQDATISLPFTPEKPSLLYWGMQGSPNVYGDIKMESFMLSEDTTKFILDGCHSVFRTDTVDILLSAIIYSFGRTFTDRRVPTIYNEGHGREAWEADIDLSRTVGWFTTMAPLLVDSEARALNDIIKRVKDTRRKIADNGRPYFAKNLLQDQGSDFPVPLEILFNYLGKMQQLERADSLFHHHGSVFDSSDFAVAGDMGPQTARFALFEVSAIVIKERLNVAFTYNNKMQHQGSIRRWILQCKQTLDKDILTLKTATPEPTLSDYPLLPINYHGLQMLTASTFRKAGIRNKDDVEDIYPCSPMQEGLLLSQLRDPNAYMFHTVFEIKDGKSGKVDAEGVARAWQALVDRHPVLRTIFVDSNYTGGSFDQLVLKNLSDNILRVQCQDSQVEEKLAAISLRDRNAMRQAKLSHQLTVCKTNTGRVILKLEMNHAIIDGGSVDVLLRDLTLAYERKIAEGSGPLFSDYIKLIRTQSHSDALSHWKEYLGGVHPCHLAPSAVFEAKRELKGVKMNFQRFPELLKFCERSSVTLANLTLSAWAIVLRQFVGSDDVCFGYLSAGRDAPVDGIQDMVGIFINMLCCRVQFSDQQTLTDVSKSVQDDYIRCIPHQSCSLASIQHELGWQGQSLFNTTLSIQNHSVAGGPKDKGLSFDLQHAHDPSEYAVTVNVEIARGQEGILLRYWNDIVSDEEAQSLADTIAKVFTGFIESPAATLSQSTFASEAEPESVDWDRSQTTLADKAKSTGEAIDSSAMQKIIDDRVHEIIGQMLREGKLTVPPIRTEGLSSYGGHTDTIADSPYQLGIQGADDSGVCSATSRSSEDGMSVDVERKLWNLWSTALGLSPNVVRHQDSFFKLGGDSITAMKMVSAAREEGLVLTVADVFNNPVFEDMLTTVRAANVTQQMLNADLKSGGHKEVDSDLLNITPTTLGPSPSTESLEVLKPSCVDDAAVQRGICPKVGVFKGGIADVLPVTDFQAMSLTATLFKSRWMLNYFYLEGNGPLDLRRLRESCLKVVAAFDILRTVFVCFHDQFFQVVLRKIRPSIFVYETDRALDEFTMTLQQRDREYGPREGEQYVQFYVVKKKNSDQHRIMIRLSHTQYDGVCLPKIMAAIKHGYEGTPLPPVTPFAGYLRQLPGTITPDHYRHWTDLLKGSHMTQVVRRRGTSMFQNVGAFTEIHRKIEISPTALGNVTIATVMQAAWALALAKLSAQSDVIFGLTISGRNATVPGIESTVGPCVNVIPVRVKFDEKWTGVDLFRYLQDQQVSNMPFESLGFREIIKQCTDWPDWTYFTTSVFHQNVDYEGNMQLDNNKYRMGGVGVNDNLADLTMVSRPSGERGLDVTLGYSEKGPVMPSFASKVLDMACEIAQSLVANPTASLPSASMLRSLPPQTIDDQPRPTDEHFLSAHLKSRSIAELLVHSDILSRSWHQVLPSRTTTGPVDPEADKPTHQSAFQLDSSFFDLGGDVFNLAQLTWLLEQEGLKVRLEDLIEHPSFLGQMAVLALHNAKHQEDMPTELLATGAAPPDPVARIEKKKTWSKAMTIARKLTGRNTVTSRA

SEQ ID NO: 35 - DNA, 23321 bp, Aspergillus niger
accaaagaactctcctttctcaattttctgtctggttcacttgtgggtgtcgaaagattcgtcatcctgcattagaagctagatttctcgacgtcggagtgatccgtcggatttgaatttggcatacgaagaagtcactttatgttaatagcttactcatgcgcttcagataattaactagtatcgtagttatttccttaccttgtatgtatttaatatactgatgtttattggtagggtggcactagctctgctccgacggccagggctgaccgtctttactacctaatagaggaaacggtaaactccgctgttaataactttaatacattattgccgccatgacacccgctctatctgggtgtacctgacccaaaacatccaatacactttgcggagtacatgtaaaacagtaaatagtcaatatacaaaatgagggcattatgtaattagtagcataagtcgacttggcttttcaggtcagatcgcgtgtaagggaaataccgaaaaagggtacttgtcatgtgagcccctcttcgctttttctgttctatttctttttgtctaattttttattcccccccgagtccggatgattatttatctatttaattatttttcccctaccactcgaacaaggaatactagcccctggttgtggggggaacgtatacgagtttcagttggacatgagatccatactcataacaaggcatattatcgactagagctggctttagggtatggagccgtacaagccccaattggatccgagcattggcttcccgatcaggaactggacttttgtatggacccagtcagtagcaaccacagcgagttcactgtccactctccgtgtccactccgcgccctcccccccccccccccagtagcacctggatctcttttccctactcgcctgcagtgtctgagtttcggggtttcctactcgctccttaccgttccgacagttctccgacagccttccgaatatacttagcgttatagccgctacgtgcaattacccaggtaggtataccacctggtgacttggcccaacgtcgagactaagacagctgagccttttcacttcgccgactttattcctgcaagacttcccactggtcagcatgcagtctgtcagtcctgtaccgtagattccagcatgtagtggagctggatgctaatgcagcgcctttctgacagacagagctcctaatcgaatgttgttaagcgttcgagaccgacctcgaagttccgggatgattgagagccgacataatgcacccaaagctggatacgccctctttatgcgccccgattttgagcaccaaccaacgtcatgccttggcttgtattgtattgttaagcgtgtcaaggccggtttccttgatttggattcggcctgcccagggtcaaactaatattttttttttctcattttctttttgtcttctttggtcctttgccccattgcctttcctgctgtctacccgcccctggttatacactacaaagtgggcaacccgagtttgatggtttcaagccatcggcttttgggttcaagcgccctgcagaactttgtaagccatggaatctcttccctgttgcctcttcagcttcgcctaagcaagggcatatggagtatactgtattagcgtggtggccaaaatccacgccattcattgcactacttcccgacccagtcattggccgccgtcattttcgtatttcgatgctcgtaagcaattgcaaatgctgctgagggaattccgcgcctaggtctctctatggatctattttgggccgagagaatttttggggggaccccatgataatggtggctccatggggacaggcttgatttcgttttaaaagtagcatattgtacgggggttggagatttctaggataacccatccactccctcccccttctcctctaggtgttccatcccaaatcctcagagagagatactttccggtacccccatctacattatggcccaacctgtctcttgttgcttgcccaagtttggcacgagcactcatgggccaaggcggcctgcttcgttgaggatcaggacgagtccttcccagactctccagttgctagccgcttgggaccaatccgagttagattctttactcaaggccacttgggccttgcttcttcatcgctatactggcctagaggacatttgctttggttaccaaccgattggagttgatgccggtccccgcgatactgttacttcttccgatacccataataatattcccttaacttttaatctgaccattaccgaggacgactctgtccatgccattttgcgcaacacaaaaaagcagaacgaagctgaaaaatgcggaagttcaagctcgagttgccacagttataccctgtgcaatacccttctaatgctgcgcaactgtcgcagtgttacgaaagatcccagagcccctcttgtgcaaccggccttggcaattcccttgcccgaaaaggtgggtgactttcctcgttctttggcgtcctctcactttctcttcgctccatctccccttcccccctcccaccttcgatcgtgtgcgcttctatcagcccaccgctgcaggtggccttggccttttaacccggactggctgacctctctgtagtgccgcgtcaggctgcacgtcaaagtcctgcagaaggatgtcggtatcttcttcgaatggtggaacaatgatatgtccactgagcatatgaagagcgtcgccgactacttcgagcagatactttcacgcgtactctcggcagaagatactgccgcgagggacctgaaccatttctcagatcgagattggtccagagtctgcaatttcaactctaccatcccccaggcacatgaccgctgtatacacgaggtcattcatgagcaagtcctggctcgccccggaagtgaagcagtttgtgcgtgggatggaagtttgacctaccaagatctggatctcctgtcatcccaagttgcttatcaccttcaagcacacggagtcggccctgaaaaatgtgtcgctctgtgtttcaacaaatcagtaagtttaacatcaaagatcgatatgtcctttggggcaggttgtgtcatcaagtgactcggcattttcgctattcgggactgactgattctcatagaaatggaatgtagtggcaatgctgggtgttctgaaagctggcggtgctttcgtcccccttgatccaacacatccaacctctcgtctacagtcgctggtgcacgctgtgcaagccaaggtcatgctttgctccagagaccgaataggagaattgactggggtagcggagatgataataccactggaccaggctatcatagacgaaatctcccttcaagctgaagaaatctactcattgccggatgtacaaggtcacaatgcagcctacgtgatattcacttctggatcaacaggagaacctaaggtgcgctattcctcgaagcttcccccagatccacattaacagcccgcgtttagggtaccatgctagagcacagagcctatgtatccggagccgctgcccatgctggaccgcaccatatgttttcgacttcacgcgtcttgcagtttgcggcacacacgtttgatgccagtcttgtcgagatcttgactaccttgttgcaaggcggctgtgtctgcattccaagtgaagaagaacgcttgagtgacatagtcaaggtcatcaacgagatgaacataaaccatgctattttgaccccatcctttgttgagttcattgattcctcgcaagtcccaggtcttgagaccttgattcttgctggagaggcgatgtcacaaggccagctggaaacatggtcgtccgccctccacctcatcaacgcctatggccccacagaaagctctgttgctgccgttgttaacgccaaagttacaccatcttctgattgtcgggatattggactccccgtgggcgtacgttgctgggttgtagacccgagcaatcatgaccaattagtacccgtgggttgtccgggtgaattactgcttgagggaccgacgctcgctcgatgctatctcaacaatcctcagaagacaagtgaagcgttcatccatgatccagcctggatgagaagggacggattaaatgactgtaaccggagagtgtacaagacgggtgatctggtaagatacaactccgactgtggctcactgacgtatataggcagaaaagacacgcaggtgaagtttcatggacagagacttgagttgggcgagatagaaaaccagctggctgccgacccaattgtcaaacactgtctagcttttctttcgaagtcagggttctctgcaggcaaattggtggcggtaatatccttatctgttcacttcgaatctcaaccggaatcaaatgcagcgccactcaagctccttgatacatcgaagaagacctctatcgttgcagaagttcgcgagagattatcagctaaactaccaacctacatgataccctccgtttggctgtgtgtggaggcattgccgttgcttccgtctgggaagctggacagaaaggcgaccgcaagatggattggagatatggagcgagacccgtatgcccaagctataagcgccaggactttgtctgcggataaagccacacttccttcgagtgccacggaggacaaactcgctgcgatctggagccgggttctcaatatcccccgaagccaacttgcccttgacgaaggctttttgagtctaggtggagactctattgccgccataacgtgcctcgggtattgcaagaagcaaggaatgggcttgacggtacaagaggtgcttcatagcaagtcaatcaaggagctggctactcgggtaaaacagatcgatcaatttgttgtgtacgaagaaaagatcgatgagccctttgacctttcaccaatccagaagcttcacttcatggtccgaaacgagggccaaggccacttcaaccaaagcattcttacacgcctgaaccggcacattgatgagcatagcatgcgacgtgcaattgagaccattatcaatcgtcactctatgctccgctctcgcctggtcgaatcagacgttgaggggataatgcggcaaagaataactcaagacgtagcagggtcttaccgttggcgttctcacaacaacagcaaccgaagcgaggtcgaccatgctatctcgaacagccagtcatgcatcaatgccttcgttggccccgtacttgcaatagatgtcttctatggaaatgaccattcccgcctgctgtcactcgtggctcatcatatggtagtcgacattgtttcgtggaggattattttggaagacttggaagacctactgatgaaccccgatcaaccgatatcacagaacggctcccttccgtttcagaactggtgccaaattcaagcagatcgttgtcaagaagcgacagctgaacgaaccatggatctgcctgaagttcccgcacccgattttgcctactggggactaaaaagccaccaaaccacctatggcgatgtggattgtgaaacgttcgatcttgacagtgatattactcgccacatactgactgggtgccacgaaagtcttcaaacagagccaatcgatctttttctagcagctttgctacactccttcggcgaaacgttcaaagaccgatcattgccagttatatacaatgagggacatgggcgagaagtctgggactcatcaatagatatctctcgcactatcggctggtttaccacactgtatcccattcttctatcggaacttcctgcaaaagatccaaccgaaacggttgtacgtgttaaggatttgcgacgttgtgttccggacaatggtcgacatgatttcgctcgtcgtatgttggttccacgcgaagatgggacttgtcggcactatagccccatggagatgtctttcaactatgtgggccagcaccgtgacctacagagaaaggatgggctcttccaactcatggatcagatggctggagaaacaggccgcggaggtgcagcggctgattttggtgaagaaactcctcgctttgcactgttcgagatatctgcgatggttgtgcagggtcaacttcgctttatcttctccttcaataggaatatgcagcatcagaatggtatccgtaactgggtacactgctgcaaaacattactggcatccctgggcgaacgcttacaggctctcccaccgaaaccaacgctaagcagtttccccatgttaacattgacatataccgaactcgatgcgttggtgtcgaaaaaattaccggatgccggtattcatagtcttgatgatgttgaggacatctatccttgctccagaatgcagcagggcattctactcagtcgctctcgcgatagctcactttatgctgtacatgacacattcgaaatatccgggccaggaagcacacccgacatcaaccgattgatacttgcctggcagaaagtcgttgctcaccatgcaatgctacggactatatttctggaggggttgagcagccacgacctacattgtcaagtggtgctcaaatcgttcgattcccgcccaacttacgtcgtatgtgcgaatgaaagcgaagtgctacctacatttgacaaacagcaaccgatgagctacgataatagtatacctcctcatcggcttacaatctgccaaacggcttctgggaagctgttttgtcgactggagctgaaccatgtcgccatggatggcgcatcaatctccatcatccttcgggatctgcaattagcgtaccaaggaaagctcgaagaaccaaagccgaagttcaaagagtatatacgctaccttcgtgaggttccccaagtcgcaagtcttgactattggcgcaattatttgttggatgtccaaccttgtcatttccccgtgctcaatgacggcaaaggctctgtaaggcagcttcggaccaagagattgggcggtgtgccattcaaagagctacgaaccatctgcgatatgaatggtctgacccttccgactgcctttagtgctgcatggggattaacggttcgctccttttgtggatcagatgacatctccttcacctatcttgcatcactaagagatgtcccagtagagggcgttgaatatgttgttggacctgtcatcaataccctgacctgtcgtatgctgtttgctaaagggacgtcactgaaggagatcctcgcaaaagttcaacaggataacctggacaatttgccgcacaggcatatctcactcacggagatccagcaagctttgggactaacagcctcattggctaatagtggtatttcttaccggaagcttcccaatcagaatgctttgtcaagcgaggagatacagttctctgaagtggggacaattcacgacccggcagagtcgcccgtttttgtcaatgttgaagctacagaagacgacgcacgtatcgaccttaactactggacagaccacctgtcggacgggcaagcagagaatgtcgcgagcacattccttaaatcggttgaaaatattgtgcaccactttgaggatgacgcccattcaattgacaactttagcgacgcgaacagacaaagcctaatgctttggaatagcgaagtcccaaagtccatcgacaaatgcatgcatgagatagttgatgagtgtgcgaaatcccaccctcacaccatggcaatttctgcttgggatggaaacctcacttatgctaagctcaatgaattgtcatcgctacttgcaacgtacttgacaacactaggggtgggccccggaacaatcgtgccccttgatctcgctagatcctcctggcaagttgtagccatcttggcagtcatgaagacaggtggtgtatgtgttccggtgaacccagcccgactgccacaacatttcgagacttggctcgtcgacaatgagatccaggttgccctagcatcaccgactcaaatgcaactactcgaaggggccgttccatatgtaatttccgtggagagctctctgtttgaatacctttcagacagtgatgcagtttcaagctcaccaattcagccatgcagcgatgcatatatcgtgttcggcgctgagagtcccaagtgcatcttgattgaccatcgtgcaataacaacccgggcaagcgcgttcgcttcaggtcttggactaaatgcacgaacaaagatgctccaatacgctccctatacttctgacatgttccttcaagaagtcttcggcacgttcctgtgcggtgggtctatctgcattccgtcagatgaagacctggcagacctgtcaaaagccatcaagacaatgcaggcgaactgtgtcagtatcacaccctcaatggcgatgactctaagattcgcagaggatctggggataaaggtccttgctttatggggtgaacacccgaccaagcaacttcttaccgccctgcctggaggaatccaagtgcatgcattctatggaacgccagaatgctcatcttcttgcattcgatcctctcagcttgacggatcatgcgaatcgtcaattattgggtcaagtcttggatgtaaatcttggcttgtagatccctccgatcacgatattttggttccgatcggctgcgttggcgaattgatgatagaaggcccaagtctttctcatggttactatcaagatgcggaactcacgcaacaatatttcgtcgaaaatcccttttggagactggcatacgaatcccagccatcatcagacaaagacaagaacacggacgcccagaagctgtcctatcgattgttcaagactggagatcttgctcgctacaactccgatggcacactcgtttacgttggtaagaaagatagaggattgcattggcagcgacagacagcggccatttacgtcgaagagcaaatcgcatctctctcatccttcaatgcccagtatgtcgttgaggagatcagcaagagaaatgtcgattctccccgatcgtctctggccatctttttctctgatgaggccgtcgactccaagggacaccaccagcctattgcacaattgtcacctgagctgcacgactcaatgatcaggctgtataaaaagctgtcgagctccttgccagcgaattctgtcccgagactgtattttccgacgtctagcataccactgaactcgttcggtaagctagaccgccagctgctgagaaatgcagctcaaaatctgccagaaggattgctgtctagattcgacatcaaaagctttgacagcttctggaaagggcagctggccacattggcggtttcgccagtgttcccgccaccccgtggctctttgtctcagccgagcacaccggtcaccaagcaagcaacaagaaacatgcagatggtctggtgtgatacactcagatcaatgaccgaaggtacacgatgtgctatcctttctgcatgggctcttactattcgcggctacaccagctcccgtgatattgtttttggggagttgctgtcagaagttgaattggcctccactgagcgtcaggacaattatacgcaagctgcaactatcgttccccgacgcttccaactcaacgatgattggaccgttactgagctactgagcagggtgaagaaccaactggagtcagctaagccctaccaatgggctggaataagtcaaattcagaaattgaacgctgatacggcgcgcgcctgtgatttcatgaacttgatctctataacggacaatcgtggccttgaaccaagtctagtacccatgaaacagcatgacagcaatctgtccggttatcctttgatggttgattgtatccttggagatgctacgctcgaactcttgattagttacgatgacagcactttaacaggcacccagatcgagcgactggctgcccaattcttcgcttgtgttggacttcttaactccaaggctagcatgagcaagacaattggtatcttgtccagagacaacatggacttttgctccttccgccatgatgttgcctactggaaaaactacttggaggatgttgaagcttgtcttttcccggcactacgtgcacgtgcggaggaaaatactcatgctgagactcagataatactccagaacaccaagcatctacatgatctcagtgaacgtgaacgtctcagcaaaagctcacttcttcagcttgtttggggcttggttctgcgatgctacacaggcctacaagatgtgtgcttcggatatcacatttcagatgcaagcgacagatctgccaagcctggagttgcgaataagccagatatttcaggtacattcccgtgcagaatgctcttgaatggtgaatctagggttgcggaaattttgagagagcgactgcaaggactgaatcaaatgcagcagcatcggttgccgtgggatgaagtccagcaagagcttgggtgtagcgacattttcaataccgttttcacttgttcagaacaatcaagtgacgcagtaaatgtggctggtctcgctgatcttgatccgagcaaatacctgattaccgtcaacgccactctagcagaatcatcaggagtcattaggttcggctatcaaaggaggcacttctcagaaaccgacatggaaggcgtccttgattgttttaataatattctgggacagttactccaatttcctcttccggatcttttggtaggcgaggttgactttgtgagtgagctttcctgccagaagatatctgagtggaactcggcgctgccagaccgtccagtgctatgcgcgcatgagctcatccaacagcaagccttggatcgtgctacggctcctgcaatttgttcttgggatggcaacttcacatatgcacaacttgaccgattgtcgactctcctagcaaaccagctggtgggcttaggggtcaagcccgacatctttgttgcattgtgtttcgaaaagtccgcatgggcagttgttgcacaggttgctgttttgaaagctggaggagccttcgcttcattagatccagctcacccagaaagccgcctacaaggcatgatcgatgatcttggcgctcaggttattctctgttctgagacacactacgagagagcctccagcatctgtcgtcgcgcaatgatcgtaagcaatagcgcacttgaacaactttaccactcaccctttgctgctccgacccaagaggtaaccgctgataacgcagcctacgccatattcacatcgggaaccacagggaaacccaaggtgacagtacttgagcatgttggacttaccctagcctgcacagagctctccagggccttcttcataagttcagaaacacgcgctctgcagttctcaagctatacattcgacgtcagcatattggaaactatcatagtccttgctgctggtggttgcatttgtatccctagcgaagatgagcgcatgaacaatctttctggagccatcagaaagatgaacgtcaacttcatgagctgtactccatctatcgttaataccatggaccccaatgctgttccttcattgcgaacaataactctcggaggagaaaaaatgactgcaagccatttcgagcgatgggctgacaggtgtgttattaacgcgtacggtccgtcagaggctactgtcgcctttacgtcaagcacaaaatacgaccatgcaggagtacgccttactgatgactatggttctattggcactgctatttgtggcaggacatggattgttgatccccaaaatcacaatcgacttgtgcccatcggcgcacccggagagctcgttcttgagagttgcactgttgctcgtgggtatctcaataatgacgggaaaaccaaggctgttttcatccgggacccggagtggactcagcgtgaagggctacagcatgtgttgaggcgcaaagaacggatgtatcgcacgggagatttagtgcgctacaactccgacggctcgattgctttcatttcgcgaattgatacacaagtgaaattgaacggtgtgcgcatcgaattggaagaagttgagcaacaatgcaacaactatctttcgacagatactcaggttgccgttgaggttgttactccagaggccaaaactatatcaaaatgcttggctgtcttcttcaccattgacgagcaccaaatgaaagatatggcgaatggtgaattcattctgcccatgtcagagtctgtagttcacatggtcaagaagctacacggttccctaagcgcttcattaccgctagctatggtgcccaagctttacttccccatgcggcgcctgccgtttggaagcactggcaaaactgatcgcaaagcacttcgagcaatggtcgatacatttaccaaggaacgcttgagaccatatgttatcttcaatgttggcacagaagaacgctccgatgtgggaacggaagggacagagggcgttctcaagacgctatgggaggaagtccttaaccttgcgccaggttctatcagtgccgaagacaacttcttcggcatgggtggcgactcgttttctgctatgaaactagtcgtagccgcggcatcccagaatatttcacttgcagtggccgacatataccgaactcctatattcaaagacatggcaaagacatgtggagcgggtgaggtacagactggcgtaccaacagtggaccctttcagcatgctgcctgaatctctttcacgcgatgatattctggaggaagtctctgatcaatgtggtgtgcctatggatcgaattgcggacatctacccttgtagtccggtgcaagagggcttgctcacactttctatcaaacaacccggagcctatgtcgctcgacctgtgttccaactcgcagagggagctgaccttgacaagtttaaagctgcatggcaaaaggtggttaatgaaatggatattcttcggactcgggtagtacacaccgagtccgccaactttgtccaggcagtgctcactgatgtccctatcctctgggaaacggcaacggaattggatgatttagcaaacgacactattgacctagccaagaataacgggggcttgctaactggatacgccattgtcgagtccggacactcgcgctccttcgtttggaccatacaccacgctctctatgatggatggagtgtgtcccagatccttcaacgagttgaggagatatactcgggtgcttcaaaacttagctcgacgcttccttacaagctctttatcaatcacctggtccagcaagaggctcattcctcggacgaattctggaagacacacctcgcggccctgtcttcatgtcctttcccccagaacaagccgtcacctgataccattcgcgtcggcaatcggcattacagctcgcttgagatttctcatgcaccaagtgggcctaatttaaccgttcctgaaatgatacgagctgcatgggcactaattgtatccgtccacaccggttccggagatgtctgcttcgctgaaaccctaatgggtagaaatattgatatgcctggggctatggaagttgcaggacctcttttgacaacggttcctatacggatggctgtcaacaacgagctctcgattattcagtacctcgataatgtgcgccagctgaccacaatgatgctgccgcatcaacattctgggctccagaggattcgcaagctaagcagcgacactgcccttgcttgcgaatcccaaaatctactggttattcaatcagaacaggcccattcgaacacaagtatctgggagcaaaaggataacctgactgaaggcgaatttttcacccacccaattgttgtcgaatgcaaggttggcgaatcgcaggtggccgtaacccttcatcacgacgagcttgttttcgacagttggcaggctaagatgctcattgaacagtttaccttcgttttgagtcaactgttatcaatctccaatgaagaatccagaaagatcggagagctagaggtttccagttctcgggataaggaagaaattgctctctggaatgagagaaacctgacttgcatagacagatgtgttcatcatatcattgaggagaaagcatccctccgacctcaagctcaagccgtctgctcctgggatggacaactaacttaccaggagctttaccagcttgcttcttcgtttgcagcttacctgaaaactcgtggcgtcggtccggagactttggttccgatctgtatggacaagtctttgtgggccattgtcacaatactgggtgtcctcattgcgggtggaggatatgtcccccttgaccctgctcacccaacgtcaaggcacaaggagattctgacagaagtcgaagcccgtgtcgttctctgttctcccaagtatcaaagtcggtacactggctctgtgaaagcaatcatccctgtcagcaaagagacaatcaaggcgtattgtgctcttaaaacggcaaccgctaagactactaacaacgctacacccgaaaacgttgcattcgctatctttacctctggcagcactggtcgtgctaagggtattatcatcaaccacaaggcacttgccagcagcggcatggcattcgggcccatggtgcaccttgacgagaattctcgagctttccaatttgcctctcttacttttgatgctgctgtcatggaaacactcgtcaccttgatgcacggcggttgcgtgtgcattccaagcgaagatgaacgcttgaatgatgttgctggcgctattcgtcggatgaatgtctcttggtcattcctgactccatccatagccagtatcattgaaccgtcatccgttccatctctgagggatcttgtgtgtggtggagagaagatgtctcgcgaagtcatcaccaaatgggcacatcgggtaaacctgatgaatggatatggtccaactgaaactactatcttcgcggttatcaacacagatgttgctgccaatccggatcccgcctgtatcggccatggcattccttgcaccctaacctgggttgtcgatcctgacgaccacaacaaactaactcctctaggggctgttggtgagctggcactggaaggccccgcacttgctagggaatacctcaagaaccctaagaagacagcagaggcttttgtggatgagccggagtggattaaggccttccctagtgtcctaccttcgcccagaagaatatacaagactggagatcttgtcagatacaactctgacggttccattcaatacatcagccgcaaggaccatcaagtcaagcttcacgggcagcgcatggagcttggagagattgagcacagactatatgaggacccgcgagtccgccacgctgtggtcttactgccaacggcaggtcccctcaaacagcggttggtcactgttctttcactgaattctgtaactgcggagaaaagcatcatatcagacaatgcatgtgaacttgtcgatcggggtggatctgcacgggcagcataccaggagctcgttgctatccagaagagcttagagacacagctaccaatctacatggttccacaggcttgggctctgatcaagcagctcccaatgctcgtgtctggcaagctagacaggaagcgaatcacagcttggctggagaacgttgatgatgctgcttatgatcgcataatggaggattacgacaacataaaacgtggggatgtcgagcaagacgaggagaaagaggatgaccgagagacttctgtcaagcttcttcaggaagtcttttcccaggttctcaacttaccatctcacaaggtgggcttgaacaggtcatttgtgagcctaggtaagcaaagccataatggtaacggagtgtggagagttgctaatagtgcggtgcaggtggtgatagtatcactggaatggctgtcatttctcgagcgcgtaaacatggactcacgctgaccctccacaatgtgcttcagtcgaagtcgataaaggagctttctctagctgctcagacaagcgtcaagacagtgaaaagagaggagaagcctcatgaatacttcgaactgtctccgatccagggattgttcgttcaaacaacaacaaattttcgggattcttctcgctttaaccaaagcatgacagttcgcgttactcgaagggtcgagccaactagaatgcaacgcgccatcaaggctgttgttgaacagcactccatgttccgagcacggttgttcaagtctcgcgacggaaagtggaagcagaagatcagtgatgtatgtctagcttctccctcgctaactctgtttgggtaccggaagcttactgatttaggatgttgatgcctcataccgcttccgtcatcatatggtggaaaataaagatgcaattctccccaagatcgccgagtgtcaacggtctgtagatgctcaacatggacccatcgttgctgcagacatgttccaagtacgcaacggcatcacaatacttttcctagtggccagtcatctatgtgttgacatggtatcctggcgtattgtcctccaggacatccaagatttcctcgatgctggatcattgtccccggagaagcccctgtcattccaagcttggtgcaaccttcagcttgaacagagcaagaaaccaaatggcagagtccagctgcctttttctattcagcctcccgacctgaaatactggggcatggagcagtcccagaatctctatggggatgtcaagatggaagggttcacgcttgatgccgcagtcacgacacaaatcctcgcagcctgcaataaggttctacgcaccgaggctattgaagtcatactctccgctgttattcactctttccgtcgcacgtttactgatagagaaatgccgactatttacaacgagggccacggtcgcgaggcgtgggacagctctatcgatctctcaagaacggtgggctggttcacgactatgtgtccactgcatgttggtgaagggtcgggtaagtctaattctagcctatcaacggagcaatttctgactgctatagatctacttgacactttgaagcgtgtcaaagacacaaggcgtcacctcagcagtaagagccggtcatactttgcggaaagcctgcttcagccggaaggtaaagagggcgatgctttctctgtcccgctcgagattctgttcaactaccttggccagctgcaacagctagagcgcgatgattcgcttttccaacattatggtgaagccttcaacgcggagaccttcgagatgacaggggacatgggctcgaagacacctcggtttgctctcttcgagatctcggcgcttataatcaagaacaagcttcaggtatcgttcacttacaataagcacatgcagaaagaacagcggatcaagggctggatatctgagtgtaaacgagtgctggagcatatgtctcgtttcgagagcttcacatctgagccgacactcagcgattgtcccttactccccatcacttacgaaggcctgaacaacatggtcaagagagcattcccaaagattggaattgatagctgggatcaggttgaggaggtttatccctgctccccagtacaagaaggtatccttcttagtcagcttcgagacccggaggaatacctgttccatgtcatctttgaagtgcacccatccaagggtagcaaggtggatacaagcaagcttcgaaaggcatggtccatggttgtcagcaggcaccctatcttacggtctgtcttcattgacagcaactacaaaggcggatctttcgaccaggtagtggtcaagtcactcgacgatgaggtcattgagttccagtgccctgagtcggatgcattgggtacacttggggaaataaagctgcgcgatatcaatgctgagagatcgatgaagctcgcccaccagatgaccctctgcaaaacaacttctgggcgagtcctgttcaagattgagatgaaccatgccattatcgatggcgggtcggttgatctgcttcttcgggatctcgccctcgcatacagtgatcagctttctgccggaaccggtccacgttttagtgattatgtcaagtatatcagggaacaatcccagggagaagcagtggcacactgggtgaagtatctttctggcgtgcgaccttgtcacctcctggtatcttccaaaaagagcggtagccaccagctcggcgagcgcatgatatctttcaagcgcttctctgagttgcaaagattctgcgaggaaaattccgtcacactcgctaacttgaccctctgtgcctgggcaattgtactccggaattgtacaggatctgatgatgtctgcttcggatatccgtctgctggtcgtgactcccctgttcctgggatccaagatgcggtcggtatcttcatcaacatgttgtgctgtagagtcaaattctctcccggacaaactcttcttgagattgccaagaaggtacaggatgactttgtcaggaatgtgccgcatcaacactgctctctggctcagatccagcatgagcttggaatgcatggagagacgctcttcaactcaactctttccattcagaatcgctctgccaacaaaggcactagaaatttgccgctcgacttcgaagcccaaaaggcccatgacccgactgaggtgagttgataccgtctcgagcgtagacgcgagctaaccattgatttagtatcctgttactgtaaatgtggagactaccaagggcaaggagggagttttgctgaggtactggagcaacgcagtgaccgaagcacaagcaaaggagctagcggaagctgttaacaaggtctttacatgcttcatcgaggagccatccaagctggtatcgagcttgaacctccttaacaagctaccgcggaaccgttcgcagcacacgcacagggagccccttattttggaccagttgattgacagtcaggtcctacagaagctaattgacgatcgcgtgaatgagataatcagccaaatgctgaaggaaggcaagctcgccataccccttcctgatcagaagactagatactcgaacagctctgttcaactcaagatggtcgaggcttcgctccaggaggatcccataatagacgaaaaggatcttgcaaactcaacaccatccctaacagatgatggcagaagctcaagtgacaatgataggcgcctttgggacctgtggaagtcgacattagggctatcttcagacactatccaataccggagtagctttttcaagctaggcggtgatagtattacagcaatgaagatggtcagcgctgcacgagaagagggcttgcaaatgacagtggcggatgtgttcaacaacccgatcttcgaggacatgctggctacgattactccgagcagcagcccgacctcaaacgccgatacccagtgcgcaaacaacattgaaaaactcctggaggttaatgatgcccttccagatgctaccccaccgcaggatatctcggtgcttaggccaatgcagctcgatgccatgtctctgcttgatgtcatctgccctaagataggggtgttcaaaggaggaattgctgatgttctccctgttacggacttccaatccatgtcgatcgctgccacgctcttcggatcgaggtggatgctgaactatttcttcctcgatggaagtggtcctctagaccttcgacgactgagggaaagcttcttgagggtggtcgatgctttcgatatccttcgaactgtttttgtctgccaccacgggcagttcttccaggtggtgctgagaaaagtccgaccggacatttttgtgcatgagacggagcagagtctagatgagtacaccaacagcttacaaaaacgggaccgcgaacaagatccacgccaaggtgagcagtatgtgcagttctacgttgtcaagaataagaatagcgaccagcatcgcatcttgatcaggatgtcgcatgcccaattcgacggcgtttgtctgccaaagattatgaacgcaatcaagctgggatacgagggcagcaccctacctccagtcttctccttttcgaactatatgcggatgcttcctggaaacatcaccccggcacactaccaccactggtcaacaatactcaagggctctaagatgaccgatatcattcggcgcacgcagcctaataccttcatgcatattggtgctttcgctgagcagaagaagacgataatgataccctcaaccgccataggaaatgtcaccctcgcgaccgttatgcagtccgcatgggcggtgactttggcaaaactgactgcccagtcggacgtggtcttcgggcttacagtcaacggccgtaacgccagtgttcctggtattgagaccactgttgggccctgtcttaacattcttcccattagggttaaattcagggagcattggactggccttgacctcttccgttatctccaagatcaacagatcgccaacatgccctatgagtcgctaggattcagggagattatccggaactgcaccgattggcccgactccacatacttcaccacctccgtgtttcatcagaatgtcgagtatgagggacagatgcatctagacggcaattcgtaccggatgggaggcgttggtgttttggacaacttcactgatctcacgctggcctccaaatcctgtggtcaagagaagctcgatgtctcaatcgggtactcgctcaaaggccccattccagcaaccttcatcgctaaagcccttaacatggtttgcgagactgtgcagagcctgattgccaatcccagcgtcccacttgcctcccctgccactatccgctccctgcctagccaagtcattcgtgaaacacccagggcatctgatacacccttcctctcgtcaaatctaaacagccagaagatgtcggagattgtaattcactcagatatccttacccggtcctggcagcaggtgctaccccgtcggactgacaacccacaataccaactcgatgcatctttcttcgacctgggcggagacatcatgaatgttgcccaactggtctggatcctgggagaagaaggcttcagtgtccgtttggaagaccttctcgagcaccatacgttcctgggaatgatggccgtgatggcgatgcaccacaagccggaactgaatgccagaatggcagcgaccatggctgaagaaccagccaaggacatgagaatgactatgacaaagagcaacagctggagctcgctgggcaaagcgatgacgcttgctaagagatttactagatggggggctgtagcagccaaaaagtgaggtttacattcattgtggaggatacataacataacacactctttcgatttctaacatgtactattctgtttttttctgtaacgcatataattgtgtcgaactacattcctttttgtttccatgtttgccgttgaatattgactgtcttcttttgcaaactagatcgtatgatgatgatgatctagatctcttgttattaaaagctcatttgataatctgtgttttcatagatctgttttgactacagctcatcatcttgatagttttaaaccctcccaactagtctgggattggtagagaatgatatagagactatgtttataccatcattccccaccactattattaccatggactatgtactgttaggatcataccacatgggtattcaccaacaaatgcacttaaggctccgcgacgcaatgagccaccttaactatgctgcacaataccatacaattacattacatgtcaagacgaagggtcaagaacatatggatttgatctatctagatctcaagaagatggttggtggttggaagaggtggtggtcagagaccacgcaggaagaaaggcgaaggatcagctgacagctgcctggctgcagtgaatgtctcaacattacattatgcgttcgccgctgtatgagggaaccaagcgccgcgctgcggcagcctaggctcaatttgactagaggaaccactttggtacagcattacaggcatccatacaaccaaggcagacctgagtagactgcattaatcactatacgtagatgcaaaaacgatagctatatctaaatcattccatttaactaaacctagacattaatcggtgataatacgttattcctgtctatcaaaaccccggccgtgctatgcgtgtcatgccatataaaacaaatcaaaccaaacaaaaccagaggtatctcgagcaatccgacacaaaatcccagtgaacaaaacttttataaatcttacccgcttcatttcaactttggaagactggcatagaatggacgtgggggtatatgtgaacgcgatgggtataggaagagagacgacgtttctgagcaaaaacatccaagataggtaagaggtaggatcagtacccgtaaaccgaagcccgggaccactttcccttcgccctgatgcgctttccgaagatatagaacaggtaagggatcgggatcaatgcgacagccacaaaacctagcacactcgcagcccagtccacaccaagacgatggaacatgatattagcgaagagagggaagcagcccgcgaacagacttctcaggaaagtgttcgccgcaacagcactagcggagactttctggaaggtgtcgatcaggtagttcagggcagcttggaagatggtgaagaagccgaaacccatgcagacggcgccgatgatgggagcgatccaatggatgtgggggtcacttgtccaggcgaagatgaagagaccggcggcgaaaacgatagagccgagcatcattgggggcagacgggcttcagggacggggaagttgttgttcgctttaaagcgagcgatgtagaatttctggttgaagaggttaatgcaggcgccgaagaggataccgacgaggtaggcgaggaaaggcagggcgccgacgacttggttccagccgcggacttcttggaattcgatggggaaggaggccaaactgaggtataggataccgtagacgaaggaggcgtagatggcgacgaggaagcagatgggcgtagtgaggagggcgaagggtcggatgagatacttattgccgagttccttgaaggtgacgtcccattcttcatgacgggcgtggagagcccagttgcctgtttcgaagcggagtcgctgagccttgtaaacgaggagaacagccgggtagctctcgtcgaggaagatgaggtccatcgcgaggaagaacatcatcatgattccggtaatgtattcggtccagcgccagccgagatagctctggcagatgg

SEQ ID NO: 36 - DNA, 18726 bp, Aspergillus niger
atggcccaacctgtctcttgttgcttgcccaagtttggcacgagcactcatgggccaaggcggcctgcttcgttgaggatcaggacgagtccttcccagactctccagttgctagccgcttgggaccaatccgagttagattctttactcaaggccacttgggccttgcttcttcatcgctatactggcctagaggacatttgctttggttaccaaccgattggagttgatgccggtccccgcgatactgttacttcttccgatacccataataatattcccttaacttttaatctgaccattaccgaggacgactctgtccatgccattttgcgcaacacaaaaaagcagaacgaagctgaaaaatgcggaagttcaagctcgagttgccacagttataccctgtgcaatacccttctaatgctgcgcaactgtcgcagtgttacgaaagatcccagagcccctcttgtgcaaccggccttggcaattcccttgcccgaaaagtgccgcgtcaggctgcacgtcaaagtcctgcagaaggatgtcggtatcttcttcgaatggtggaacaatgatatgtccactgagcatatgaagagcgtcgccgactacttcgagcagatactttcacgcgtactctcggcagaagatactgccgcgagggacctgaaccatttctcagatcgagattggtccagagtctgcaatttcaactctaccatcccccaggcacatgaccgctgtatacacgaggtcattcatgagcaagtcctggctcgccccggaagtgaagcagtttgtgcgtgggatggaagtttgacctaccaagatctggatctcctgtcatcccaagttgcttatcaccttcaagcacacggagtcggccctgaaaaatgtgtcgctctgtgtttcaacaaatcaaaatggaatgtagtggcaatgctgggtgttctgaaagctggcggtgctttcgtcccccttgatccaacacatccaacctctcgtctacagtcgctggtgcacgctgtgcaagccaaggtcatgctttgctccagagaccgaataggagaattgactggggtagcggagatgataataccactggaccaggctatcatagacgaaatctcccttcaagctgaagaaatctactcattgccggatgtacaaggtcacaatgcagcctacgtgatattcacttctggatcaacaggagaacctaagggtaccatgctagagcacagagcctatgtatccggagccgctgcccatgctggaccgcaccatatgttttcgacttcacgcgtcttgcagtttgcggcacacacgtttgatgccagtcttgtcgagatcttgactaccttgttgcaaggcggctgtgtctgcattccaagtgaagaagaacgcttgagtgacatagtcaaggtcatcaacgagatgaacataaaccatgctattttgaccccatcctttgttgagttcattgattcctcgcaagtcccaggtcttgagaccttgattcttgctggagaggcgatgtcacaaggccagctggaaacatggtcgtccgccctccacctcatcaacgcctatggccccacagaaagctctgttgctgccgttgttaacgccaaagttacaccatcttctgattgtcgggatattggactccccgtgggcgtacgttgctgggttgtagacccgagcaatcatgaccaattagtacccgtgggttgtccgggtgaattactgcttgagggaccgacgctcgctcgatgctatctcaacaatcctcagaagacaagtgaagcgttcatccatgatccagcctggatgagaagggacggattaaatgactgtaaccggagagtgtacaagacgggtgatctggtaagatacaactccgactgtggctcactgacgtatataggcagaaaagacacgcaggtgaagtttcatggacagagacttgagttgggcgagatagaaaaccagctggctgccgacccaattgtcaaacactgtctagcttttctttcgaagtcagggttctctgcaggcaaattggtggcggtaatatccttatctgttcacttcgaatctcaaccggaatcaaatgcagcgccactcaagctccttgatacatcgaagaagacctctatcgttgcagaagttcgcgagagattatcagctaaactaccaacctacatgataccctccgtttggctgtgtgtggaggcattgccgttgcttccgtctgggaagctggacagaaaggcgaccgcaagatggattggagatatggagcgagacccgtatgcccaagctataagcgccaggactttgtctgcggataaagccacacttccttcgagtgccacggaggacaaactcgctgcgatctggagccgggttctcaatatcccccgaagccaacttgcccttgacgaaggctttttgagtctaggtggagactctattgccgccataacgtgcctcgggtattgcaagaagcaaggaatgggcttgacggtacaagaggtgcttcatagcaagtcaatcaaggagctggctactcgggtaaaacagatcgatcaatttgttgtgtacgaagaaaagatcgatgagccctttgacctttcaccaatccagaagcttcacttcatggtccgaaacgagggccaaggccacttcaaccaaagcattcttacacgcctgaaccggcacattgatgagcatagcatgcgacgtgcaattgagaccattatcaatcgtcactctatgctccgctctcgcctggtcgaatcagacgttgaggggataatgcggcaaagaataactcaagacgtagcagggtcttaccgttggcgttctcacaacaacagcaaccgaagcgaggtcgaccatgctatctcgaacagccagtcatgcatcaatgccttcgttggccccgtacttgcaatagatgtcttctatggaaatgaccattcccgcctgctgtcactcgtggctcatcatatggtagtcgacattgtttcgtggaggattattttggaagacttggaagacctactgatgaaccccgatcaaccgatatcacagaacggctcccttccgtttcagaactggtgccaaattcaagcagatcgttgtcaagaagcgacagctgaacgaaccatggatctgcctgaagttcccgcacccgattttgcctactggggactaaaaagccaccaaaccacctatggcgatgtggattgtgaaacgttcgatcttgacagtgatattactcgccacatactgactgggtgccacgaaagtcttcaaacagagccaatcgatctttttctagcagctttgctacactccttcggcgaaacgttcaaagaccgatcattgccagttatatacaatgagggacatgggcgagaagtctgggactcatcaatagatatctctcgcactatcggctggtttaccacactgtatcccattcttctatcggaacttcctgcaaaagatccaaccgaaacggttgtacgtgttaaggatttgcgacgttgtgttccggacaatggtcgacatgatttcgctcgtcgtatgttggttccacgcgaagatgggacttgtcggcactatagccccatggagatgtctttcaactatgtgggccagcaccgtgacctacagagaaaggatgggctcttccaactcatggatcagatggctggagaaacaggccgcggaggtgcagcggctgattttggtgaagaaactcctcgctttgcactgttcgagatatctgcgatggttgtgcagggtcaacttcgctttatcttctccttcaataggaatatgcagcatcagaatggtatccgtaactgggtacactgctgcaaaacattactggcatccctgggcgaacgcttacaggctctcccaccgaaaccaacgctaagcagtttccccatgttaacattgacatataccgaactcgatgcgttggtgtcgaaaaaattaccggatgccggtattcatagtcttgatgatgttgaggacatctatccttgctccagaatgcagcagggcattctactcagtcgctctcgcgatagctcactttatgctgtacatgacacattcgaaatatccgggccaggaagcacacccgacatcaaccgattgatacttgcctggcagaaagtcgttgctcaccatgcaatgctacggactatatttctggaggggttgagcagccacgacctacattgtcaagtggtgctcaaatcgttcgattcccgcccaacttacgtcgtatgtgcgaatgaaagcgaagtgctacctacatttgacaaacagcaaccgatgagctacgataatagtatacctcctcatcggcttacaatctgccaaacggcttctgggaagctgttttgtcgactggagctgaaccatgtcgccatggatggcgcatcaatctccatcatccttcgggatctgcaattagcgtaccaaggaaagctcgaagaaccaaagccgaagttcaaagagtatatacgctaccttcgtgaggttccccaagtcgcaagtcttgactattggcgcaattatttgttggatgtccaaccttgtcatttccccgtgctcaatgacggcaaaggctctgtaaggcagcttcggaccaagagattgggcggtgtgccattcaaagagctacgaaccatctgcgatatgaatggtctgacccttccgactgcctttagtgctgcatggggattaacggttcgctccttttgtggatcagatgacatctccttcacctatcttgcatcactaagagatgtcccagtagagggcgttgaatatgttgttggacctgtcatcaataccctgacctgtcgtatgctgtttgctaaagggacgtcactgaaggagatcctcgcaaaagttcaacaggataacctggacaatttgccgcacaggcatatctcactcacggagatccagcaagctttgggactaacagcctcattggctaatagtggtatttcttaccggaagcttcccaatcagaatgctttgtcaagcgaggagatacagttctctgaagtggggacaattcacgacccggcagagtcgcccgtttttgtcaatgttgaagctacagaagacgacgcacgtatcgaccttaactactggacagaccacctgtcggacgggcaagcagagaatgtcgcgagcacattccttaaatcggttgaaaatattgtgcaccactttgaggatgacgcccattcaattgacaactttagcgacgcgaacagacaaagcctaatgctttggaatagcgaagtcccaaagtccatcgacaaatgcatgcatgagatagttgatgagtgtgcgaaatcccaccctcacaccatggcaatttctgcttgggatggaaacctcacttatgctaagctcaatgaattgtcatcgctacttgcaacgtacttgacaacactaggggtgggccccggaacaatcgtgccccttgatctcgctagatcctcctggcaagttgtagccatcttggcagtcatgaagacaggtggtgtatgtgttccggtgaacccagcccgactgccacaacatttcgagacttggctcgtcgacaatgagatccaggttgccctagcatcaccgactcaaatgcaactactcgaaggggccgttccatatgtaatttccgtggagagctctctgtttgaatacctttcagacagtgatgcagtttcaagctcaccaattcagccatgcagcgatgcatatatcgtgttcggcgctgagagtcccaagtgcatcttgattgaccatcgtgcaataacaacccgggcaagcgcgttcgcttcaggtcttggactaaatgcacgaacaaagatgctccaatacgctccctatacttctgacatgttccttcaagaagtcttcggcacgttcctgtgcggtgggtctatctgcattccgtcagatgaagacctggcagacctgtcaaaagccatcaagacaatgcaggcgaactgtgtcagtatcacaccctcaatggcgatgactctaagattcgcagaggatctggggataaaggtccttgctttatggggtgaacacccgaccaagcaacttcttaccgccctgcctggaggaatccaagtgcatgcattctatggaacgccagaatgctcatcttcttgcattcgatcctctcagcttgacggatcatgcgaatcgtcaattattgggtcaagtcttggatgtaaatcttggcttgtagatccctccgatcacgatattttggttccgatcggctgcgttggcgaattgatgatagaaggcccaagtctttctcatggttactatcaagatgcggaactcacgcaacaatatttcgtcgaaaatcccttttggagactggcatacgaatcccagccatcatcagacaaagacaagaacacggacgcccagaagctgtcctatcgattgttcaagactggagatcttgctcgctacaactccgatggcacactcgtttacgttggtaagaaagatagaggattgcattggcagcgacagacagcggccatttacgtcgaagagcaaatcgcatctctctcatccttcaatgcccagtatgtcgttgaggagatcagcaagagaaatgtcgattctccccgatcgtctctggccatctttttctctgatgaggccgtcgactccaagggacaccaccagcctattgcacaattgtcacctgagctgcacgactcaatgatcaggctgtataaaaagctgtcgagctccttgccagcgaattctgtcccgagactgtattttccgacgtctagcataccactgaactcgttcggtaagctagaccgccagctgctgagaaatgcagctcaaaatctgccagaaggattgctgtctagattcgacatcaaaagctttgacagcttctggaaagggcagctggccacattggcggtttcgccagtgttcccgccaccccgtggctctttgtctcagccgagcacaccggtcaccaagcaagcaacaagaaacatgcagatggtctggtgtgatacactcagatcaatgaccgaaggtacacgatgtgctatcctttctgcatgggctcttactattcgcggctacaccagctcccgtgatattgtttttggggagttgctgtcagaagttgaattggcctccactgagcgtcaggacaattatacgcaagctgcaactatcgttccccgacgcttccaactcaacgatgattggaccgttactgagctactgagcagggtgaagaaccaactggagtcagctaagccctaccaatgggctggaataagtcaaattcagaaattgaacgctgatacggcgcgcgcctgtgatttcatgaacttgatctctataacggacaatcgtggccttgaaccaagtctagtacccatgaaacagcatgacagcaatctgtccggttatcctttgatggttgattgtatccttggagatgctacgctcgaactcttgattagttacgatgacagcactttaacaggcacccagatcgagcgactggctgcccaattcttcgcttgtgttggacttcttaactccaaggctagcatgagcaagacaattggtatcttgtccagagacaacatggacttttgctccttccgccatgatgttgcctactggaaaaactacttggaggatgttgaagcttgtcttttcccggcactacgtgcacgtgcggaggaaaatactcatgctgagactcagataatactccagaacaccaagcatctacatgatctcagtgaacgtgaacgtctcagcaaaagctcacttcttcagcttgtttggggcttggttctgcgatgctacacaggcctacaagatgtgtgcttcggatatcacatttcagatgcaagcgacagatctgccaagcctggagttgcgaataagccagatatttcaggtacattcccgtgcagaatgctcttgaatggtgaatctagggttgcggaaattttgagagagcgactgcaaggactgaatcaaatgcagcagcatcggttgccgtgggatgaagtccagcaagagcttgggtgtagcgacattttcaataccgttttcacttgttcagaacaatcaagtgacgcagtaaatgtggctggtctcgctgatcttgatccgagcaaatacctgattaccgtcaacgccactctagcagaatcatcaggagtcattaggttcggctatcaaaggaggcacttctcagaaaccgacatggaaggcgtccttgattgttttaataatattctgggacagttactccaatttcctcttccggatcttttggtaggcgaggttgactttgtgagtgagctttcctgccagaagatatctgagtggaactcggcgctgccagaccgtccagtgctatgcgcgcatgagctcatccaacagcaagccttggatcgtgctacggctcctgcaatttgttcttgggatggcaacttcacatatgcacaacttgaccgattgtcgactctcctagcaaaccagctggtgggcttaggggtcaagcccgacatctttgttgcattgtgtttcgaaaagtccgcatgggcagttgttgcacaggttgctgttttgaaagctggaggagccttcgcttcattagatccagctcacccagaaagccgcctacaaggcatgatcgatgatcttggcgctcaggttattctctgttctgagacacactacgagagagcctccagcatctgtcgtcgcgcaatgatcgtaagcaatagcgcacttgaacaactttaccactcaccctttgctgctccgacccaagaggtaaccgctgataacgcagcctacgccatattcacatcgggaaccacagggaaacccaaggtgacagtacttgagcatgttggacttaccctagcctgcacagagctctccagggccttcttcataagttcagaaacacgcgctctgcagttctcaagctatacattcgacgtcagcatattggaaactatcatagtccttgctgctggtggttgcatttgtatccctagcgaagatgagcgcatgaacaatctttctggagccatcagaaagatgaacgtcaacttcatgagctgtactccatctatcgttaataccatggaccccaatgctgttccttcattgcgaacaataactctcggaggagaaaaaatgactgcaagccatttcgagcgatgggctgacaggtgtgttattaacgcgtacggtccgtcagaggctactgtcgcctttacgtcaagcacaaaatacgaccatgcaggagtacgccttactgatgactatggttctattggcactgctatttgtggcaggacatggattgttgatccccaaaatcacaatcgacttgtgcccatcggcgcacccggagagctcgttcttgagagttgcactgttgctcgtgggtatctcaataatgacgggaaaaccaaggctgttttcatccgggacccggagtggactcagcgtgaagggctacagcatgtgttgaggcgcaaagaacggatgtatcgcacgggagatttagtgcgctacaactccgacggctcgattgctttcatttcgcgaattgatacacaagtgaaattgaacggtgtgcgcatcgaattggaagaagttgagcaacaatgcaacaactatctttcgacagatactcaggttgccgttgaggttgttactccagaggccaaaactatatcaaaatgcttggctgtcttcttcaccattgacgagcaccaaatgaaagatatggcgaatggtgaattcattctgcccatgtcagagtctgtagttcacatggtcaagaagctacacggttccctaagcgcttcattaccgctagctatggtgcccaagctttacttccccatgcggcgcctgccgtttggaagcactggcaaaactgatcgcaaagcacttcgagcaatggtcgatacatttaccaaggaacgcttgagaccatatgttatcttcaatgttggcacagaagaacgctccgatgtgggaacggaagggacagagggcgttctcaagacgctatgggaggaagtccttaaccttgcgccaggttctatcagtgccgaagacaacttcttcggcatgggtggcgactcgttttctgctatgaaactagtcgtagccgcggcatcccagaatatttcacttgcagtggccgacatataccgaactcctatattcaaagacatggcaaagacatgtggagcgggtgaggtacagactggcgtaccaacagtggaccctttcagcatgctgcctgaatctctttcacgcgatgatattctggaggaagtctctgatcaatgtggtgtgcctatggatcgaattgcggacatctacccttgtagtccggtgcaagagggcttgctcacactttctatcaaacaacccggagcctatgtcgctcgacctgtgttccaactcgcagagggagctgaccttgacaagtttaaagctgcatggcaaaaggtggttaatgaaatggatattcttcggactcgggtagtacacaccgagtccgccaactttgtccaggcagtgctcactgatgtccctatcctctgggaaacggcaacggaattggatgatttagcaaacgacactattgacctagccaagaataacgggggcttgctaactggatacgccattgtcgagtccggacactcgcgctccttcgtttggaccatacaccacgctctctatgatggatggagtgtgtcccagatccttcaacgagttgaggagatatactcgggtgcttcaaaacttagctcgacgcttccttacaagctctttatcaatcacctggtccagcaagaggctcattcctcggacgaattctggaagacacacctcgcggccctgtcttcatgtcctttcccccagaacaagccgtcacctgataccattcgcgtcggcaatcggcattacagctcgcttgagatttctcatgcaccaagtgggcctaatttaaccgttcctgaaatgatacgagctgcatgggcactaattgtatccgtccacaccggttccggagatgtctgcttcgctgaaaccctaatgggtagaaatattgatatgcctggggctatggaagttgcaggacctcttttgacaacggttcctatacggatggctgtcaacaacgagctctcgattattcagtacctcgataatgtgcgccagctgaccacaatgatgctgccgcatcaacattctgggctccagaggattcgcaagctaagcagcgacactgcccttgcttgcgaatcccaaaatctactggttattcaatcagaacaggcccattcgaacacaagtatctgggagcaaaaggataacctgactgaaggcgaatttttcacccacccaattgttgtcgaatgcaaggttggcgaatcgcaggtggccgtaacccttcatcacgacgagcttgttttcgacagttggcaggctaagatgctcattgaacagtttaccttcgttttgagtcaactgttatcaatctccaatgaagaatccagaaagatcggagagctagaggtttccagttctcgggataaggaagaaattgctctctggaatgagagaaacctgacttgcatagacagatgtgttcatcatatcattgaggagaaagcatccctccgacctcaagctcaagccgtctgctcctgggatggacaactaacttaccaggagctttaccagcttgcttcttcgtttgcagcttacctgaaaactcgtggcgtcggtccggagactttggttccgatctgtatggacaagtctttgtgggccattgtcacaatactgggtgtcctcattgcgggtggaggatatgtcccccttgaccctgctcacccaacgtcaaggcacaaggagattctgacagaagtcgaagcccgtgtcgttctctgttctcccaagtatcaaagtcggtacactggctctgtgaaagcaatcatccctgtcagcaaagagacaatcaaggcgtattgtgctcttaaaacggcaaccgctaagactactaacaacgctacacccgaaaacgttgcattcgctatctttacctctggcagcactggtcgtgctaagggtattatcatcaaccacaaggcacttgccagcagcggcatggcattcgggcccatggtgcaccttgacgagaattctcgagctttccaatttgcctctcttacttttgatgctgctgtcatggaaacactcgtcaccttgatgcacggcggttgcgtgtgcattccaagcgaagatgaacgcttgaatgatgttgctggcgctattcgtcggatgaatgtctcttggtcattcctgactccatccatagccagtatcattgaaccgtcatccgttccatctctgagggatcttgtgtgtggtggagagaagatgtctcgcgaagtcatcaccaaatgggcacatcgggtaaacctgatgaatggatatggtccaactgaaactactatcttcgcggttatcaacacagatgttgctgccaatccggatcccgcctgtatcggccatggcattccttgcaccctaacctgggttgtcgatcctgacgaccacaacaaactaactcctctaggggctgttggtgagctggcactggaaggccccgcacttgctagggaatacctcaagaaccctaagaagacagcagaggcttttgtggatgagccggagtggattaaggccttccctagtgtcctaccttcgcccagaagaatatacaagactggagatcttgtcagatacaactctgacggttccattcaatacatcagccgcaaggaccatcaagtcaagcttcacgggcagcgcatggagcttggagagattgagcacagactatatgaggacccgcgagtccgccacgctgtggtcttactgccaacggcaggtcccctcaaacagcggttggtcactgttctttcactgaattctgtaactgcggagaaaagcatcatatcagacaatgcatgtgaacttgtcgatcggggtggatctgcacgggcagcataccaggagctcgttgctatccagaagagcttagagacacagctaccaatctacatggttccacaggcttgggctctgatcaagcagctcccaatgctcgtgtctggcaagctagacaggaagcgaatcacagcttggctggagaacgttgatgatgctgcttatgatcgcataatggaggattacgacaacataaaacgtggggatgtcgagcaagacgaggagaaagaggatgaccgagagacttctgtcaagcttcttcaggaagtcttttcccaggttctcaacttaccatctcacaaggtgggcttgaacaggtcatttgtgagcctaggtggtgatagtatcactggaatggctgtcatttctcgagcgcgtaaacatggactcacgctgaccctccacaatgtgcttcagtcgaagtcgataaaggagctttctctagctgctcagacaagcgtcaagacagtgaaaagagaggagaagcctcatgaatacttcgaactgtctccgatccagggattgttcgttcaaacaacaacaaattttcgggattcttctcgctttaaccaaagcatgacagttcgcgttactcgaagggtcgagccaactagaatgcaacgcgccatcaaggctgttgttgaacagcactccatgttccgagcacggttgttcaagtctcgcgacggaaagtggaagcagaagatcagtgatgatgttgatgcctcataccgcttccgtcatcatatggtggaaaataaagatgcaattctccccaagatcgccgagtgtcaacggtctgtagatgctcaacatggacccatcgttgctgcagacatgttccaagacatccaagatttcctcgatgctggatcattgtccccggagaagcccctgtcattccaagcttggtgcaaccttcagcttgaacagagcaagaaaccaaatggcagagtccagctgcctttttctattcagcctcccgacctgaaatactggggcatggagcagtcccagaatctctatggggatgtcaagatggaagggttcacgcttgatgccgcagtcacgacacaaatcctcgcagcctgcaataaggttctacgcaccgaggctattgaagtcatactctccgctgttattcactctttccgtcgcacgtttactgatagagaaatgccgactatttacaacgagggccacggtcgcgaggcgtgggacagctctatcgatctctcaagaacggtgggctggttcacgactatgtgtccactgcatgttggtgaagggtcggatctacttgacactttgaagcgtgtcaaagacacaaggcgtcacctcagcagtaagagccggtcatactttgcggaaagcctgcttcagccggaaggtaaagagggcgatgctttctctgtcccgctcgagattctgttcaactaccttggccagctgcaacagctagagcgcgatgattcgcttttccaacattatggtgaagccttcaacgcggagaccttcgagatgacaggggacatgggctcgaagacacctcggtttgctctcttcgagatctcggcgcttataatcaagaacaagcttcaggtatcgttcacttacaataagcacatgcagaaagaacagcggatcaagggctggatatctgagtgtaaacgagtgctggagcatatgtctcgtttcgagagcttcacatctgagccgacactcagcgattgtcccttactccccatcacttacgaaggcctgaacaacatggtcaagagagcattcccaaagattggaattgatagctgggatcaggttgaggaggtttatccctgctccccagtacaagaaggtatccttcttagtcagcttcgagacccggaggaatacctgttccatgtcatctttgaagtgcacccatccaagggtagcaaggtggatacaagcaagcttcgaaaggcatggtccatggttgtcagcaggcaccctatcttacggtctgtcttcattgacagcaactacaaaggcggatctttcgaccaggtagtggtcaagtcactcgacgatgaggtcattgagttccagtgccctgagtcggatgcattgggtacacttggggaaataaagctgcgcgatatcaatgctgagagatcgatgaagctcgcccaccagatgaccctctgcaaaacaacttctgggcgagtcctgttcaagattgagatgaaccatgccattatcgatggcgggtcggttgatctgcttcttcgggatctcgccctcgcatacagtgatcagctttctgccggaaccggtccacgttttagtgattatgtcaagtatatcagggaacaatcccagggagaagcagtggcacactgggtgaagtatctttctggcgtgcgaccttgtcacctcctggtatcttccaaaaagagcggtagccaccagctcggcgagcgcatgatatctttcaagcgcttctctgagttgcaaagattctgcgaggaaaattccgtcacactcgctaacttgaccctctgtgcctgggcaattgtactccggaattgtacaggatctgatgatgtctgcttcggatatccgtctgctggtcgtgactcccctgttcctgggatccaagatgcggtcggtatcttcatcaacatgttgtgctgtagagtcaaattctctcccggacaaactcttcttgagattgccaagaaggtacaggatgactttgtcaggaatgtgccgcatcaacactgctctctggctcagatccagcatgagcttggaatgcatggagagacgctcttcaactcaactctttccattcagaatcgctctgccaacaaaggcactagaaatttgccgctcgacttcgaagcccaaaaggcccatgacccgactgagtatcctgttactgtaaatgtggagactaccaagggcaaggagggagttttgctgaggtactggagcaacgcagtgaccgaagcacaagcaaaggagctagcggaagctgttaacaaggtctttacatgcttcatcgaggagccatccaagctggtatcgagcttgaacctccttaacaagctaccgcggaaccgttcgcagcacacgcacagggagccccttattttggaccagttgattgacagtcaggtcctacagaagctaattgacgatcgcgtgaatgagataatcagccaaatgctgaaggaaggcaagctcgccataccccttcctgatcagaagactagatactcgaacagctctgttcaactcaagatggtcgaggcttcgctccaggaggatcccataatagacgaaaaggatcttgcaaactcaacaccatccctaacagatgatggcagaagctcaagtgacaatgataggcgcctttgggacctgtggaagtcgacattagggctatcttcagacactatccaataccggagtagctttttcaagctaggcggtgatagtattacagcaatgaagatggtcagcgctgcacgagaagagggcttgcaaatgacagtggcggatgtgttcaacaacccgatcttcgaggacatgctggctacgattactccgagcagcagcccgacctcaaacgccgatacccagtgcgcaaacaacattgaaaaactcctggaggttaatgatgcccttccagatgctaccccaccgcaggatatctcggtgcttaggccaatgcagctcgatgccatgtctctgcttgatgtcatctgccctaagataggggtgttcaaaggaggaattgctgatgttctccctgttacggacttccaatccatgtcgatcgctgccacgctcttcggatcgaggtggatgctgaactatttcttcctcgatggaagtggtcctctagaccttcgacgactgagggaaagcttcttgagggtggtcgatgctttcgatatccttcgaactgtttttgtctgccaccacgggcagttcttccaggtggtgctgagaaaagtccgaccggacatttttgtgcatgagacggagcagagtctagatgagtacaccaacagcttacaaaaacgggaccgcgaacaagatccacgccaaggtgagcagtatgtgcagttctacgttgtcaagaataagaatagcgaccagcatcgcatcttgatcaggatgtcgcatgcccaattcgacggcgtttgtctgccaaagattatgaacgcaatcaagctgggatacgagggcagcaccctacctccagtcttctccttttcgaactatatgcggatgcttcctggaaacatcaccccggcacactaccaccactggtcaacaatactcaagggctctaagatgaccgatatcattcggcgcacgcagcctaataccttcatgcatattggtgctttcgctgagcagaagaagacgataatgataccctcaaccgccataggaaatgtcaccctcgcgaccgttatgcagtccgcatgggcggtgactttggcaaaactgactgcccagtcggacgtggtcttcgggcttacagtcaacggccgtaacgccagtgttcctggtattgagaccactgttgggccctgtcttaacattcttcccattagggttaaattcagggagcattggactggccttgacctcttccgttatctccaagatcaacagatcgccaacatgccctatgagtcgctaggattcagggagattatccggaactgcaccgattggcccgactccacatacttcaccacctccgtgtttcatcagaatgtcgagtatgagggacagatgcatctagacggcaattcgtaccggatgggaggcgttggtgttttggacaacttcactgatctcacgctggcctccaaatcctgtggtcaagagaagctcgatgtctcaatcgggtactcgctcaaaggccccattccagcaaccttcatcgctaaagcccttaacatggtttgcgagactgtgcagagcctgattgccaatcccagcgtcccacttgcctcccctgccactatccgctccctgcctagccaagtcattcgtgaaacacccagggcatctgatacacccttcctctcgtcaaatctaaacagccagaagatgtcggagattgtaattcactcagatatccttacccggtcctggcagcaggtgctaccccgtcggactgacaacccacaataccaactcgatgcatctttcttcgacctgggcggagacatcatgaatgttgcccaactggtctggatcctgggagaagaaggcttcagtgtccgtttggaagaccttctcgagcaccatacgttcctgggaatgatggccgtgatggcgatgcaccacaagccggaactgaatgccagaatggcagcgaccatggctgaagaaccagccaaggacatgagaatgactatgacaaagagcaacagctggagctcgctgggcaaagcgatgacgcttgctaagagatttactagatggggggctgtagcagccaaaaagtga

SEQ ID NO: 37 - RNA, 18726 nt, Aspergillus niger
auggcccaaccugucucuuguugcuugcccaaguuuggcacgagcacucaugggccaaggcggccugcuucguugaggaucaggacgaguccuucccagacucuccaguugcuagccgcuugggaccaauccgaguuagauucuuuacucaaggccacuugggccuugcuucuucaucgcuauacuggccuagaggacauuugcuuugguuaccaaccgauuggaguugaugccgguccccgcgauacuguuacuucuuccgauacccauaauaauauucccuuaacuuuuaaucugaccauuaccgaggacgacucuguccaugccauuuugcgcaacacaaaaaagcagaacgaagcugaaaaaugcggaaguucaagcucgaguugccacaguuauacccugugcaauacccuucuaaugcugcgcaacugucgcaguguuacgaaagaucccagagccccucuugugcaaccggccuuggcaauucccuugcccgaaaagugccgcgucaggcugcacgucaaaguccugcagaaggaugucgguaucuucuucgaaugguggaacaaugauauguccacugagcauaugaagagcgucgccgacuacuucgagcagauacuuucacgcguacucucggcagaagauacugccgcgagggaccugaaccauuucucagaucgagauugguccagagucugcaauuucaacucuaccaucccccaggcacaugaccgcuguauacacgaggucauucaugagcaaguccuggcucgccccggaagugaagcaguuugugcgugggauggaaguuugaccuaccaagaucuggaucuccugucaucccaaguugcuuaucaccuucaagcacacggagucggcccugaaaaaugugucgcucuguguuucaacaaaucaaaauggaauguaguggcaaugcuggguguucugaaagcuggcggugcuuucgucccccuugauccaacacauccaaccucucgucuacagucgcuggugcacgcugugcaagccaaggucaugcuuugcuccagagaccgaauaggagaauugacugggguagcggagaugauaauaccacuggaccaggcuaucauagacgaaaucucccuucaagcugaagaaaucuacucauugccggauguacaaggucacaaugcagccuacgugauauucacuucuggaucaacaggagaaccuaaggguaccaugcuagagcacagagccuauguauccggagccgcugcccaugcuggaccgcaccauauguuuucgacuucacgcgucuugcaguuugcggcacacacguuugaugccagucuugucgagaucuugacuaccuuguugcaaggcggcugugucugcauuccaagugaagaagaacgcuugagugacauagucaaggucaucaacgagaugaacauaaaccaugcuauuuugaccccauccuuuguugaguucauugauuccucgcaagucccaggucuugagaccuugauucuugcuggagaggcgaugucacaaggccagcuggaaacauggucguccgcccuccaccucaucaacgccuauggccccacagaaagcucuguugcugccguuguuaacgccaaaguuacaccaucuucugauugucgggauauuggacuccccgugggcguacguugcuggguuguagacccgagcaaucaugaccaauuaguacccguggguuguccgggugaauuacugcuugagggaccgacgcucgcucgaugcuaucucaacaauccucagaagacaagugaagcguucauccaugauccagccuggaugagaagggacggauuaaaugacuguaaccggagaguguacaagacgggugaucugguaagauacaacuccgacuguggcucacugacguauauaggcagaaaagacacgcaggugaaguuucauggacagagacuugaguugggcgagauagaaaaccagcuggcugccgacccaauugucaaacacugucuagcuuuucuuucgaagucaggguucucugcaggcaaauugguggcgguaauauccuuaucuguucacuucgaaucucaaccggaaucaaaugcagcgccacucaagcuccuugauacaucgaagaagaccucuaucguugcagaaguucgcgagagauuaucagcuaaacuaccaaccuacaugauacccuccguuuggcuguguguggaggcauugccguugcuuccgucugggaagcuggacagaaaggcgaccgcaagauggauuggagauauggagcgagacccguaugcccaagcuauaagcgccaggacuuugucugcggauaaagccacacuuccuucgagugccacggaggacaaacucgcugcgaucuggagccggguucucaauaucccccgaagccaacuugcccuugacgaaggcuuuuugagucuagguggagacucuauugccgccauaacgugccucggguauugcaagaagcaaggaaugggcuugacgguacaagaggugcuucauagcaagucaaucaaggagcuggcuacucggguaaaacagaucgaucaauuuguuguguacgaagaaaagaucgaugagcccuuugaccuuucaccaauccagaagcuucacuucaugguccgaaacgagggccaaggccacuucaaccaaagcauucuuacacgccugaaccggcacauugaugagcauagcaugcgacgugcaauugagaccauuaucaaucgucacucuaugcuccgcucucgccuggucgaaucagacguugaggggauaaugcggcaaagaauaacucaagacguagcagggucuuaccguuggcguucucacaacaacagcaaccgaagcgaggucgaccaugcuaucucgaacagccagucaugcaucaaugccuucguuggccccguacuugcaauagaugucuucuauggaaaugaccauucccgccugcugucacucguggcucaucauaugguagucgacauuguuucguggaggauuauuuuggaagacuuggaagaccuacugaugaaccccgaucaaccgauaucacagaacggcucccuuccguuucagaacuggugccaaauucaagcagaucguugucaagaagcgacagcugaacgaaccauggaucugccugaaguucccgcacccgauuuugccuacuggggacuaaaaagccaccaaaccaccuauggcgauguggauugugaaacguucgaucuugacagugauauuacucgccacauacugacugggugccacgaaagucuucaaacagagccaaucgaucuuuuucuagcagcuuugcuacacuccuucggcgaaacguucaaagaccgaucauugccaguuauauacaaugagggacaugggcgagaagucugggacucaucaauagauaucucucgcacuaucggcugguuuaccacacuguaucccauucuucuaucggaacuuccugcaaaagauccaaccgaaacgguuguacguguuaaggauuugcgacguuguguuccggacaauggucgacaugauuucgcucgucguauguugguuccacgcgaagaugggacuugucggcacuauagccccauggagaugucuuucaacuaugugggccagcaccgugaccuacagagaaaggaugggcucuuccaacucauggaucagauggcuggagaaacaggccgcggaggugcagcggcugauuuuggugaagaaacuccucgcuuugcacuguucgagauaucugcgaugguugugcagggucaacuucgcuuuaucuucuccuucaauaggaauaugcagcaucagaaugguauccguaacuggguacacugcugcaaaacauuacuggcaucccugggcgaacgcuuacaggcucucccaccgaaaccaacgcuaagcaguuuccccauguuaacauugacauauaccgaacucgaugcguuggugucgaaaaaauuaccggaugccgguauucauagucuugaugauguugaggacaucuauccuugcuccagaaugcagcagggcauucuacucagucgcucucgcgauagcucacuuuaugcuguacaugacacauucgaaauauccgggccaggaagcacacccgacaucaaccgauugauacuugccuggcagaaagucguugcucaccaugcaaugcuacggacuauauuucuggagggguugagcagccacgaccuacauugucaaguggugcucaaaucguucgauucccgcccaacuuacgucguaugugcgaaugaaagcgaagugcuaccuacauuugacaaacagcaaccgaugagcuacgauaauaguauaccuccucaucggcuuacaaucugccaaacggcuucugggaagcuguuuugucgacuggagcugaaccaugucgccauggauggcgcaucaaucuccaucauccuucgggaucugcaauuagcguaccaaggaaagcucgaagaaccaaagccgaaguucaaagaguauauacgcuaccuucgugagguuccccaagucgcaagucuugacuauuggcgcaauuauuuguuggauguccaaccuugucauuuccccgugcucaaugacggcaaaggcucuguaaggcagcuucggaccaagagauugggcggugugccauucaaagagcuacgaaccaucugcgauaugaauggucugacccuuccgacugccuuuagugcugcauggggauuaacgguucgcuccuuuuguggaucagaugacaucuccuucaccuaucuugcaucacuaagagaugucccaguagagggcguugaauauguuguuggaccugucaucaauacccugaccugucguaugcuguuugcuaaagggacgucacugaaggagauccucgcaaaaguucaacaggauaaccuggacaauuugccgcacaggcauaucucacucacggagauccagcaagcuuugggacuaacagccucauuggcuaauagugguauuucuuaccggaagcuucccaaucagaaugcuuugucaagcgaggagauacaguucucugaaguggggacaauucacgacccggcagagucgcccguuuuugucaauguugaagcuacagaagacgacgcacguaucgaccuuaacuacuggacagaccaccugucggacgggcaagcagagaaugucgcgagcacauuccuuaaaucgguugaaaauauugugcaccacuuugaggaugacgcccauucaauugacaacuuuagcgacgcgaacagacaaagccuaaugcuuuggaauagcgaagucccaaaguccaucgacaaaugcaugcaugagauaguugaugagugugcgaaaucccacccucacaccauggcaauuucugcuugggauggaaaccucacuuaugcuaagcucaaugaauugucaucgcuacuugcaacguacuugacaacacuaggggugggccccggaacaaucgugccccuugaucucgcuagauccuccuggcaaguuguagccaucuuggcagucaugaagacaggugguguauguguuccggugaacccagcccgacugccacaacauuucgagacuuggcucgucgacaaugagauccagguugcccuagcaucaccgacucaaaugcaacuacucgaaggggccguuccauauguaauuuccguggagagcucucuguuugaauaccuuucagacagugaugcaguuucaagcucaccaauucagccaugcagcgaugcauauaucguguucggcgcugagagucccaagugcaucuugauugaccaucgugcaauaacaacccgggcaagcgcguucgcuucaggucuuggacuaaaugcacgaacaaagaugcuccaauacgcucccuauacuucugacauguuccuucaagaagucuucggcacguuccugugcggugggucuaucugcauuccgucagaugaagaccuggcagaccugucaaaagccaucaagacaaugcaggcgaacugugucaguaucacacccucaauggcgaugacucuaagauucgcagaggaucuggggauaaagguccuugcuuuauggggugaacacccgaccaagcaacuucuuaccgcccugccuggaggaauccaagugcaugcauucuauggaacgccagaaugcucaucuucuugcauucgauccucucagcuugacggaucaugcgaaucgucaauuauugggucaagucuuggauguaaaucuuggcuuguagaucccuccgaucacgauauuuugguuccgaucggcugcguuggcgaauugaugauagaaggcccaagucuuucucaugguuacuaucaagaugcggaacucacgcaacaauauuucgucgaaaaucccuuuuggagacuggcauacgaaucccagccaucaucagacaaagacaagaacacggacgcccagaagcuguccuaucgauuguucaagacuggagaucuugcucgcuacaacuccgauggcacacucguuuacguugguaagaaagauagaggauugcauuggcagcgacagacagcggccauuuacgucgaagagcaaaucgcaucucucucauccuucaaugcccaguaugucguugaggagaucagcaagagaaaugucgauucuccccgaucgucucuggccaucuuuuucucugaugaggccgucgacuccaagggacaccaccagccuauugcacaauugucaccugagcugcacgacucaaugaucaggcuguauaaaaagcugucgagcuccuugccagcgaauucugucccgagacuguauuuuccgacgucuagcauaccacugaacucguucgguaagcuagaccgccagcugcugagaaaugcagcucaaaaucugccagaaggauugcugucuagauucgacaucaaaagcuuugacagcuucuggaaagggcagcuggccacauuggcgguuucgccaguguucccgccaccccguggcucuuugucucagccgagcacaccggucaccaagcaagcaacaagaaacaugcagauggucuggugugauacacucagaucaaugaccgaagguacacgaugugcuauccuuucugcaugggcucuuacuauucgcggcuacaccagcucccgugauauuguuuuuggggaguugcugucagaaguugaauuggccuccacugagcgucaggacaauuauacgcaagcugcaacuaucguuccccgacgcuuccaacucaacgaugauuggaccguuacugagcuacugagcagggugaagaaccaacuggagucagcuaagcccuaccaaugggcuggaauaagucaaauucagaaauugaacgcugauacggcgcgcgccugugauuucaugaacuugaucucuauaacggacaaucguggccuugaaccaagucuaguacccaugaaacagcaugacagcaaucuguccgguuauccuuugaugguugauuguauccuuggagaugcuacgcucgaacucuugauuaguuacgaugacagcacuuuaacaggcacccagaucgagcgacuggcugcccaauucuucgcuuguguuggacuucuuaacuccaaggcuagcaugagcaagacaauugguaucuuguccagagacaacauggacuuuugcuccuuccgccaugauguugccuacuggaaaaacuacuuggaggauguugaagcuugucuuuucccggcacuacgugcacgugcggaggaaaauacucaugcugagacucagauaauacuccagaacaccaagcaucuacaugaucucagugaacgugaacgucucagcaaaagcucacuucuucagcuuguuuggggcuugguucugcgaugcuacacaggccuacaagaugugugcuucggauaucacauuucagaugcaagcgacagaucugccaagccuggaguugcgaauaagccagauauuucagguacauucccgugcagaaugcucuugaauggugaaucuaggguugcggaaauuuugagagagcgacugcaaggacugaaucaaaugcagcagcaucgguugccgugggaugaaguccagcaagagcuuggguguagcgacauuuucaauaccguuuucacuuguucagaacaaucaagugacgcaguaaauguggcuggucucgcugaucuugauccgagcaaauaccugauuaccgucaacgccacucuagcagaaucaucaggagucauuagguucggcuaucaaaggaggcacuucucagaaaccgacauggaaggcguccuugauuguuuuaauaauauucugggacaguuacuccaauuuccucuuccggaucuuuugguaggcgagguugacuuugugagugagcuuuccugccagaagauaucugaguggaacucggcgcugccagaccguccagugcuaugcgcgcaugagcucauccaacagcaagccuuggaucgugcuacggcuccugcaauuuguucuugggauggcaacuucacauaugcacaacuugaccgauugucgacucuccuagcaaaccagcuggugggcuuaggggucaagcccgacaucuuuguugcauuguguuucgaaaaguccgcaugggcaguuguugcacagguugcuguuuugaaagcuggaggagccuucgcuucauuagauccagcucacccagaaagccgccuacaaggcaugaucgaugaucuuggcgcucagguuauucucuguucugagacacacuacgagagagccuccagcaucugucgucgcgcaaugaucguaagcaauagcgcacuugaacaacuuuaccacucacccuuugcugcuccgacccaagagguaaccgcugauaacgcagccuacgccauauucacaucgggaaccacagggaaacccaaggugacaguacuugagcauguuggacuuacccuagccugcacagagcucuccagggccuucuucauaaguucagaaacacgcgcucugcaguucucaagcuauacauucgacgucagcauauuggaaacuaucauaguccuugcugcuggugguugcauuuguaucccuagcgaagaugagcgcaugaacaaucuuucuggagccaucagaaagaugaacgucaacuucaugagcuguacuccaucuaucguuaauaccauggaccccaaugcuguuccuucauugcgaacaauaacucucggaggagaaaaaaugacugcaagccauuucgagcgaugggcugacagguguguuauuaacgcguacgguccgucagaggcuacugucgccuuuacgucaagcacaaaauacgaccaugcaggaguacgccuuacugaugacuaugguucuauuggcacugcuauuuguggcaggacauggauuguugauccccaaaaucacaaucgacuugugcccaucggcgcacccggagagcucguucuugagaguugcacuguugcucguggguaucucaauaaugacgggaaaaccaaggcuguuuucauccgggacccggaguggacucagcgugaagggcuacagcauguguugaggcgcaaagaacggauguaucgcacgggagauuuagugcgcuacaacuccgacggcucgauugcuuucauuucgcgaauugauacacaagugaaauugaacggugugcgcaucgaauuggaagaaguugagcaacaaugcaacaacuaucuuucgacagauacucagguugccguugagguuguuacuccagaggccaaaacuauaucaaaaugcuuggcugucuucuucaccauugacgagcaccaaaugaaagauauggcgaauggugaauucauucugcccaugucagagucuguaguucacauggucaagaagcuacacgguucccuaagcgcuucauuaccgcuagcuauggugcccaagcuuuacuuccccaugcggcgccugccguuuggaagcacuggcaaaacugaucgcaaagcacuucgagcaauggucgauacauuuaccaaggaacgcuugagaccauauguuaucuucaauguuggcacagaagaacgcuccgaugugggaacggaagggacagagggcguucucaagacgcuaugggaggaaguccuuaaccuugcgccagguucuaucagugccgaagacaacuucuucggcauggguggcgacucguuuucugcuaugaaacuagucguagccgcggcaucccagaauauuucacuugcaguggccgacauauaccgaacuccuauauucaaagacauggcaaagacauguggagcgggugagguacagacuggcguaccaacaguggacccuuucagcaugcugccugaaucucuuucacgcgaugauauucuggaggaagucucugaucaauguggugugccuauggaucgaauugcggacaucuacccuuguaguccggugcaagagggcuugcucacacuuucuaucaaacaacccggagccuaugucgcucgaccuguguuccaacucgcagagggagcugaccuugacaaguuuaaagcugcauggcaaaaggugguuaaugaaauggauauucuucggacucggguaguacacaccgaguccgccaacuuuguccaggcagugcucacugaugucccuauccucugggaaacggcaacggaauuggaugauuuagcaaacgacacuauugaccuagccaagaauaacgggggcuugcuaacuggauacgccauugucgaguccggacacucgcgcuccuucguuuggaccauacaccacgcucucuaugauggauggagugugucccagauccuucaacgaguugaggagauauacucgggugcuucaaaacuuagcucgacgcuuccuuacaagcucuuuaucaaucaccugguccagcaagaggcucauuccucggacgaauucuggaagacacaccucgcggcccugucuucauguccuuucccccagaacaagccgucaccugauaccauucgcgucggcaaucggcauuacagcucgcuugagauuucucaugcaccaagugggccuaauuuaaccguuccugaaaugauacgagcugcaugggcacuaauuguauccguccacaccgguuccggagaugucugcuucgcugaaacccuaauggguagaaauauugauaugccuggggcuauggaaguugcaggaccucuuuugacaacgguuccuauacggauggcugucaacaacgagcucucgauuauucaguaccucgauaaugugcgccagcugaccacaaugaugcugccgcaucaacauucugggcuccagaggauucgcaagcuaagcagcgacacugcccuugcuugcgaaucccaaaaucuacugguuauucaaucagaacaggcccauucgaacacaaguaucugggagcaaaaggauaaccugacugaaggcgaauuuuucacccacccaauuguugucgaaugcaagguuggcgaaucgcagguggccguaacccuucaucacgacgagcuuguuuucgacaguuggcaggcuaagaugcucauugaacaguuuaccuucguuuugagucaacuguuaucaaucuccaaugaagaauccagaaagaucggagagcuagagguuuccaguucucgggauaaggaagaaauugcucucuggaaugagagaaaccugacuugcauagacagauguguucaucauaucauugaggagaaagcaucccuccgaccucaagcucaagccgucugcuccugggauggacaacuaacuuaccaggagcuuuaccagcuugcuucuucguuugcagcuuaccugaaaacucguggcgucgguccggagacuuugguuccgaucuguauggacaagucuuugugggccauugucacaauacuggguguccucauugcggguggaggauaugucccccuugacccugcucacccaacgucaaggcacaaggagauucugacagaagucgaagcccgugucguucucuguucucccaaguaucaaagucgguacacuggcucugugaaagcaaucaucccugucagcaaagagacaaucaaggcguauugugcucuuaaaacggcaaccgcuaagacuacuaacaacgcuacacccgaaaacguugcauucgcuaucuuuaccucuggcagcacuggucgugcuaaggguauuaucaucaaccacaaggcacuugccagcagcggcauggcauucgggcccauggugcaccuugacgagaauucucgagcuuuccaauuugccucucuuacuuuugaugcugcugucauggaaacacucgucaccuugaugcacggcgguugcgugugcauuccaagcgaagaugaacgcuugaaugauguugcuggcgcuauucgucggaugaaugucucuuggucauuccugacuccauccauagccaguaucauugaaccgucauccguuccaucucugagggaucuugugugugguggagagaagaugucucgcgaagucaucaccaaaugggcacaucggguaaaccugaugaauggauaugguccaacugaaacuacuaucuucgcgguuaucaacacagauguugcugccaauccggaucccgccuguaucggccauggcauuccuugcacccuaaccuggguugucgauccugacgaccacaacaaacuaacuccucuaggggcuguuggugagcuggcacuggaaggccccgcacuugcuagggaauaccucaagaacccuaagaagacagcagaggcuuuuguggaugagccggaguggauuaaggccuucccuaguguccuaccuucgcccagaagaauauacaagacuggagaucuugucagauacaacucugacgguuccauucaauacaucagccgcaaggaccaucaagucaagcuucacgggcagcgcauggagcuuggagagauugagcacagacuauaugaggacccgcgaguccgccacgcuguggucuuacugccaacggcagguccccucaaacagcgguuggucacuguucuuucacugaauucuguaacugcggagaaaagcaucauaucagacaaugcaugugaacuugucgaucgggguggaucugcacgggcagcauaccaggagcucguugcuauccagaagagcuuagagacacagcuaccaaucuacaugguuccacaggcuugggcucugaucaagcagcucccaaugcucgugucuggcaagcuagacaggaagcgaaucacagcuuggcuggagaacguugaugaugcugcuuaugaucgcauaauggaggauuacgacaacauaaaacguggggaugucgagcaagacgaggagaaagaggaugaccgagagacuucugucaagcuucuucaggaagucuuuucccagguucucaacuuaccaucucacaaggugggcuugaacaggucauuugugagccuagguggugauaguaucacuggaauggcugucauuucucgagcgcguaaacauggacucacgcugacccuccacaaugugcuucagucgaagucgauaaaggagcuuucucuagcugcucagacaagcgucaagacagugaaaagagaggagaagccucaugaauacuucgaacugucuccgauccagggauuguucguucaaacaacaacaaauuuucgggauucuucucgcuuuaaccaaagcaugacaguucgcguuacucgaagggucgagccaacuagaaugcaacgcgccaucaaggcuguuguugaacagcacuccauguuccgagcacgguuguucaagucucgcgacggaaaguggaagcagaagaucagugaugauguugaugccucauaccgcuuccgucaucauaugguggaaaauaaagaugcaauucuccccaagaucgccgagugucaacggucuguagaugcucaacauggacccaucguugcugcagacauguuccaagacauccaagauuuccucgaugcuggaucauuguccccggagaagccccugucauuccaagcuuggugcaaccuucagcuugaacagagcaagaaaccaaauggcagaguccagcugccuuuuucuauucagccucccgaccugaaauacuggggcauggagcagucccagaaucucuauggggaugucaagauggaaggguucacgcuugaugccgcagucacgacacaaauccucgcagccugcaauaagguucuacgcaccgaggcuauugaagucauacucuccgcuguuauucacucuuuccgucgcacguuuacugauagagaaaugccgacuauuuacaacgagggccacggucgcgaggcgugggacagcucuaucgaucucucaagaacggugggcugguucacgacuauguguccacugcauguuggugaagggucggaucuacuugacacuuugaagcgugucaaagacacaaggcgucaccucagcaguaagagccggucauacuuugcggaaagccugcuucagccggaagguaaagagggcgaugcuuucucugucccgcucgagauucuguucaacuaccuuggccagcugcaacagcuagagcgcgaugauucgcuuuuccaacauuauggugaagccuucaacgcggagaccuucgagaugacaggggacaugggcucgaagacaccucgguuugcucucuucgagaucucggcgcuuauaaucaagaacaagcuucagguaucguucacuuacaauaagcacaugcagaaagaacagcggaucaagggcuggauaucugaguguaaacgagugcuggagcauaugucucguuucgagagcuucacaucugagccgacacucagcgauugucccuuacuccccaucacuuacgaaggccugaacaacauggucaagagagcauucccaaagauuggaauugauagcugggaucagguugaggagguuuaucccugcuccccaguacaagaagguauccuucuuagucagcuucgagacccggaggaauaccuguuccaugucaucuuugaagugcacccauccaaggguagcaagguggauacaagcaagcuucgaaaggcaugguccaugguugucagcaggcacccuaucuuacggucugucuucauugacagcaacuacaaaggcggaucuuucgaccagguaguggucaagucacucgacgaugaggucauugaguuccagugcccugagucggaugcauuggguacacuuggggaaauaaagcugcgcgauaucaaugcugagagaucgaugaagcucgcccaccagaugacccucugcaaaacaacuucugggcgaguccuguucaagauugagaugaaccaugccauuaucgauggcgggucgguugaucugcuucuucgggaucucgcccucgcauacagugaucagcuuucugccggaaccgguccacguuuuagugauuaugucaaguauaucagggaacaaucccagggagaagcaguggcacacugggugaaguaucuuucuggcgugcgaccuugucaccuccugguaucuuccaaaaagagcgguagccaccagcucggcgagcgcaugauaucuuucaagcgcuucucugaguugcaaagauucugcgaggaaaauuccgucacacucgcuaacuugacccucugugccugggcaauuguacuccggaauuguacaggaucugaugaugucugcuucggauauccgucugcuggucgugacuccccuguuccugggauccaagaugcggucgguaucuucaucaacauguugugcuguagagucaaauucucucccggacaaacucuucuugagauugccaagaagguacaggaugacuuugucaggaaugugccgcaucaacacugcucucuggcucagauccagcaugagcuuggaaugcauggagagacgcucuucaacucaacucuuuccauucagaaucgcucugccaacaaaggcacuagaaauuugccgcucgacuucgaagcccaaaaggcccaugacccgacugaguauccuguuacuguaaauguggagacuaccaagggcaaggagggaguuuugcugagguacuggagcaacgcagugaccgaagcacaagcaaaggagcuagcggaagcuguuaacaaggucuuuacaugcuucaucgaggagccauccaagcugguaucgagcuugaaccuccuuaacaagcuaccgcggaaccguucgcagcacacgcacagggagccccuuauuuuggaccaguugauugacagucagguccuacagaagcuaauugacgaucgcgugaaugagauaaucagccaaaugcugaaggaaggcaagcucgccauaccccuuccugaucagaagacuagauacucgaacagcucuguucaacucaagauggucgaggcuucgcuccaggaggaucccauaauagacgaaaaggaucuugcaaacucaacaccaucccuaacagaugauggcagaagcucaagugacaaugauaggcgccuuugggaccuguggaagucgacauuagggcuaucuucagacacuauccaauaccggaguagcuuuuucaagcuaggcggugauaguauuacagcaaugaagauggucagcgcugcacgagaagagggcuugcaaaugacaguggcggauguguucaacaacccgaucuucgaggacaugcuggcuacgauuacuccgagcagcagcccgaccucaaacgccgauacccagugcgcaaacaacauugaaaaacuccuggagguuaaugaugcccuuccagaugcuaccccaccgcaggauaucucggugcuuaggccaaugcagcucgaugccaugucucugcuugaugucaucugcccuaagauagggguguucaaaggaggaauugcugauguucucccuguuacggacuuccaauccaugucgaucgcugccacgcucuucggaucgagguggaugcugaacuauuucuuccucgauggaagugguccucuagaccuucgacgacugagggaaagcuucuugaggguggucgaugcuuucgauauccuucgaacuguuuuugucugccaccacgggcaguucuuccagguggugcugagaaaaguccgaccggacauuuuugugcaugagacggagcagagucuagaugaguacaccaacagcuuacaaaaacgggaccgcgaacaagauccacgccaaggugagcaguaugugcaguucuacguugucaagaauaagaauagcgaccagcaucgcaucuugaucaggaugucgcaugcccaauucgacggcguuugucugccaaagauuaugaacgcaaucaagcugggauacgagggcagcacccuaccuccagucuucuccuuuucgaacuauaugcggaugcuuccuggaaacaucaccccggcacacuaccaccacuggucaacaauacucaagggcucuaagaugaccgauaucauucggcgcacgcagccuaauaccuucaugcauauuggugcuuucgcugagcagaagaagacgauaaugauacccucaaccgccauaggaaaugucacccucgcgaccguuaugcaguccgcaugggcggugacuuuggcaaaacugacugcccagucggacguggucuucgggcuuacagucaacggccguaacgccaguguuccugguauugagaccacuguugggcccugucuuaacauucuucccauuaggguuaaauucagggagcauuggacuggccuugaccucuuccguuaucuccaagaucaacagaucgccaacaugcccuaugagucgcuaggauucagggagauuauccggaacugcaccgauuggcccgacuccacauacuucaccaccuccguguuucaucagaaugucgaguaugagggacagaugcaucuagacggcaauucguaccggaugggaggcguugguguuuuggacaacuucacugaucucacgcuggccuccaaauccuguggucaagagaagcucgaugucucaaucggguacucgcucaaaggccccauuccagcaaccuucaucgcuaaagcccuuaacaugguuugcgagacugugcagagccugauugccaaucccagcgucccacuugccuccccugccacuauccgcucccugccuagccaagucauucgugaaacacccagggcaucugauacacccuuccucucgucaaaucuaaacagccagaagaugucggagauuguaauucacucagauauccuuacccgguccuggcagcaggugcuaccccgucggacugacaacccacaauaccaacucgaugcaucuuucuucgaccugggcggagacaucaugaauguugcccaacuggucuggauccugggagaagaaggcuucaguguccguuuggaagaccuucucgagcaccauacguuccugggaaugauggccgugauggcgaugcaccacaagccggaacugaaugccagaauggcagcgaccauggcugaagaaccagccaaggacaugagaaugacuaugacaaagagcaacagcuggagcucgcugggcaaagcgaugacgcuugcuaagagauuuacuagauggggggcuguagcagccaaaaaguga

SEQ ID NO: 38 - protein, 6241 aa, Aspergillus niger
MAQPVSCCLPKFGTSTHGPRRPASLRIRTSPSQTLQLLAAWDQSELDSLLKATWALLLHRYTGLEDICFGYQPIGVDAGPRDTVTSSDTHNNIPLTFNLTITEDDSVHAILRNTKKQNEAEKCGSSSSSCHSYTLCNTLLMLRNCRSVTKDPRAPLVQPALAIPLPEKCRVRLHVKVLQKDVGIFFEWWNNDMSTEHMKSVADYFEQILSRVLSAEDTAARDLNHFSDRDWSRVCNFNSTIPQAHDRCIHEVIHEQVLARPGSEAVCAWDGSLTYQDLDLLSSQVAYHLQAHGVGPEKCVALCFNKSKWNVVAMLGVLKAGGAFVPLDPTHPTSRLQSLVHAVQAKVMLCSRDRIGELTGVAEMIIPLDQAIIDEISLQAEEIYSLPDVQGHNAAYVIFTSGSTGEPKGTMLEHRAYVSGAAAHAGPHHMFSTSRVLQFAAHTFDASLVEILTTLLQGGCVCIPSEEERLSDIVKVINEMNINHAILTPSFVEFIDSSQVPGLETLILAGEAMSQGQLETWSSALHLINAYGPTESSVAAVVNAKVTPSSDCRDIGLPVGVRCWVVDPSNHDQLVPVGCPGELLLEGPTLARCYLNNPQKTSEAFIHDPAWMRRDGLNDCNRRVYKTGDLVRYNSDCGSLTYIGRKDTQVKFHGQRLELGEIENQLAADPIVKHCLAFLSKSGFSAGKLVAVISLSVHFESQPESNAAPLKLLDTSKKTSIVAEVRERLSAKLPTYMIPSVWLCVEALPLLPSGKLDRKATARWIGDMERDPYAQAISARTLSADKATLPSSATEDKLAAIWSRVLNIPRSQLALDEGFLSLGGDSIAAITCLGYCKKQGMGLTVQEVLHSKSIKELATRVKQIDQFVVYEEKIDEPFDLSPIQKLHFMVRNEGQGHFNQSILTRLNRHIDEHSMRRAIETIINRHSMLRSRLVESDVEGIMRQRITQDVAGSYRWRSHNNSNRSEVDHAISNSQSCINAFVGPVLAIDVFYGNDHSRLLSLVAHHMVVDIVSWRIILEDLEDLLMNPDQPISQNGSLPFQNWCQIQADRCQEATAERTMDLPEVPAPDFAYWGLKSHQTTYGDVDCETFDLDSDITRHILTGCHESLQTEPIDLFLAALLHSFGETFKDRSLPVIYNEGHGREVWDSSIDISRTIGWFTTLYPILLSELPAKDPTETVVRVKDLRRCVPDNGRHDFARRMLVPREDGTCRHYSPMEMSFNYVGQHRDLQRKDGLFQLMDQMAGETGRGGAAADFGEETPRFALFEISAMVVQGQLRFIFSFNRNMQHQNGIRNWVHCCKTLLASLGERLQALPPKPTLSSFPMLTLTYTELDALVSKKLPDAGIHSLDDVEDIYPCSRMQQGILLSRSRDSSLYAVHDTFEISGPGSTPDINRLILAWQKVVAHHAMLRTIFLEGLSSHDLHCQVVLKSFDSRPTYVVCANESEVLPTFDKQQPMSYDNSIPPHRLTICQTASGKLFCRLELNHVAMDGASISIILRDLQLAYQGKLEEPKPKFKEYIRYLREVPQVASLDYWRNYLLDVQPCHFPVLNDGKGSVRQLRTKRLGGVPFKELRTICDMNGLTLPTAFSAAWGLTVRSFCGSDDISFTYLASLRDVPVEGVEYVVGPVINTLTCRMLFAKGTSLKEILAKVQQDNLDNLPHRHISLTEIQQALGLTASLANSGISYRKLPNQNALSSEEIQFSEVGTIHDPAESPVFVNVEATEDDARIDLNYWTDHLSDGQAENVASTFLKSVENIVHHFEDDAHSIDNFSDANRQSLMLWNSEVPKSIDKCMHEIVDECAKSHPHTMAISAWDGNLTYAKLNELSSLLATYLTTLGVGPGTIVPLDLARSSWQVVAILAVMKTGGVCVPVNPARLPQHFETWLVDNEIQVALASPTQMQLLEGAVPYVISVESSLFEYLSDSDAVSSSPIQPCSDAYIVFGAESPKCILIDHRAITTRASAFASGLGLNARTKMLQYAPYTSDMFLQEVFGTFLCGGSICIPSDEDLADLSKAIKTMQANCVSITPSMAMTLRFAEDLGIKVLALWGEHPTKQLLTALPGGIQVHAFYGTPECSSSCIRSSQLDGSCESSIIGSSLGCKSWLVDPSDHDILVPIGCVGELMIEGPSLSHGYYQDAELTQQYFVENPFWRLAYESQPSSDKDKNTDAQKLSYRLFKTGDLARYNSDGTLVYVGKKDRGLHWQRQTAAIYVEEQIASLSSFNAQYVVEEISKRNVDSPRSSLAIFFSDEAVDSKGHHQPIAQLSPELHDSMIRLYKKLSSSLPANSVPRLYFPTSSIPLNSFGKLDRQLLRNAAQNLPEGLLSRFDIKSFDSFWKGQLATLAVSPVFPPPRGSLSQPSTPVTKQATRNMQMVWCDTLRSMTEGTRCAILSAWALTIRGYTSSRDIVFGELLSEVELASTERQDNYTQAATIVPRRFQLNDDWTVTELLSRVKNQLESAKPYQWAGISQIQKLNADTARACDFMNLISITDNRGLEPSLVPMKQHDSNLSGYPLMVDCILGDATLELLISYDDSTLTGTQIERLAAQFFACVGLLNSKASMSKTIGILSRDNMDFCSFRHDVAYWKNYLEDVEACLFPALRARAEENTHAETQIILQNTKHLHDLSERERLSKSSLLQLVWGLVLRCYTGLQDVCFGYHISDASDRSAKPGVANKPDISGTFPCRMLLNGESRVAEILRERLQGLNQMQQHRLPWDEVQQELGCSDIFNTVFTCSEQSSDAVNVAGLADLDPSKYLITVNATLAESSGVIRFGYQRRHFSETDMEGVLDCFNNILGQLLQFPLPDLLVGEVDFVSELSCQKISEWNSALPDRPVLCAHELIQQQALDRATAPAICSWDGNFTYAQLDRLSTLLANQLVGLGVKPDIFVALCFEKSAWAVVAQVAVLKAGGAFASLDPAHPESRLQGMIDDLGAQVILCSETHYERASSICRRAMIVSNSALEQLYHSPFAAPTQEVTADNAAYAIFTSGTTGKPKVTVLEHVGLTLACTELSRAFFISSETRALQFSSYTFDVSILETIIVLAAGGCICIPSEDERMNNLSGAIRKMNVNFMSCTPSIVNTMDPNAVPSLRTITLGGEKMTASHFERWADRCVINAYGPSEATVAFTSSTKYDHAGVRLTDDYGSIGTAICGRTWIVDPQNHNRLVPIGAPGELVLESCTVARGYLNNDGKTKAVFIRDPEWTQREGLQHVLRRKERMYRTGDLVRYNSDGSIAFISRIDTQVKLNGVRIELEEVEQQCNNYLSTDTQVAVEVVTPEAKTISKCLAVFFTIDEHQMKDMANGEFILPMSESVVHMVKKLHGSLSASLPLAMVPKLYFPMRRLPFGSTGKTDRKALRAMVDTFTKERLRPYVIFNVGTEERSDVGTEGTEGVLKTLWEEVLNLAPGSISAEDNFFGMGGDSFSAMKLVVAAASQNISLAVADIYRTPIFKDMAKTCGAGEVQTGVPTVDPFSMLPESLSRDDILEEVSDQCGVPMDRIADIYPCSPVQEGLLTLSIKQPGAYVARPVFQLAEGADLDKFKAAWQKVVNEMDILRTRVVHTESANFVQAVLTDVPILWETATELDDLANDTIDLAKNNGGLLTGYAIVESGHSRSFVWTIHHALYDGWSVSQILQRVEEIYSGASKLSSTLPYKLFINHLVQQEAHSSDEFWKTHLAALSSCPFPQNKPSPDTIRVGNRHYSSLEISHAPSGPNLTVPEMIRAAWALIVSVHTGSGDVCFAETLMGRNIDMPGAMEVAGPLLTTVPIRMAVNNELSIIQYLDNVRQLTTMMLPHQHSGLQRIRKLSSDTALACESQNLLVIQSEQAHSNTSIWEQKDNLTEGEFFTHPIVVECKVGESQVAVTLHHDELVFDSWQAKMLIEQFTFVLSQLLSISNEESRKIGELEVSSSRDKEEIALWNERNLTCIDRCVHHIIEEKASLRPQAQAVCSWDGQLTYQELYQLASSFAAYLKTRGVGPETLVPICMDKSLWAIVTILGVLIAGGGYVPLDPAHPTSRHKEILTEVEARVVLCSPKYQSRYTGSVKAIIPVSKETIKAYCALKTATAKTTNNATPENVAFAIFTSGSTGRAKGIIINHKALASSGMAFGPMVHLDENSRAFQFASLTFDAAVMETLVTLMHGGCVCIPSEDERLNDVAGAIRRMNVSWSFLTPSIASIIEPSSVPSLRDLVCGGEKMSREVITKWAHRVNLMNGYGPTETTIFAVINTDVAANPDPACIGHGIPCTLTWVVDPDDHNKLTPLGAVGELALEGPALAREYLKNPKKTAEAFVDEPEWIKAFPSVLPSPRRIYKTGDLVRYNSDGSIQYISRKDHQVKLHGQRMELGEIEHRLYEDPRVRHAVVLLPTAGPLKQRLVTVLSLNSVTAEKSIISDNACELVDRGGSARAAYQELVAIQKSLETQLPIYMVPQAWALIKQLPMLVSGKLDRKRITAWLENVDDAAYDRIMEDYDNIKRGDVEQDEEKEDDRETSVKLLQEVFSQVLNLPSHKVGLNRSFVSLGGDSITGMAVISRARKHGLTLTLHNVLQSKSIKELSLAAQTSVKTVKREEKPHEYFELSPIQGLFVQTTTNFRDSSRFNQSMTVRVTRRVEPTRMQRAIKAVVEQHSMFRARLFKSRDGKWKQKISDDVDASYRFRHHMVENKDAILPKIAECQRSVDAQHGPIVAADMFQDIQDFLDAGSLSPEKPLSFQAWCNLQLEQSKKPNGRVQLPFSIQPPDLKYWGMEQSQNLYGDVKMEGFTLDAAVTTQILAACNKVLRTEAIEVILSAVIHSFRRTFTDREMPTIYNEGHGREAWDSSIDLSRTVGWFTTMCPLHVGEGSDLLDTLKRVKDTRRHLSSKSRSYFAESLLQPEGKEGDAFSVPLEILFNYLGQLQQLERDDSLFQHYGEAFNAETFEMTGDMGSKTPRFALFEISALIIKNKLQVSFTYNKHMQKEQRIKGWISECKRVLEHMSRFESFTSEPTLSDCPLLPITYEGLNNMVKRAFPKIGIDSWDQVEEVYPCSPVQEGILLSQLRDPEEYLFHVIFEVHPSKGSKVDTSKLRKAWSMVVSRHPILRSVFIDSNYKGGSFDQVVVKSLDDEVIEFQCPESDALGTLGEIKLRDINAERSMKLAHQMTLCKTTSGRVLFKIEMNHAIIDGGSVDLLLRDLALAYSDQLSAGTGPRFSDYVKYIREQSQGEAVAHWVKYLSGVRPCHLLVSSKKSGSHQLGERMISFKRFSELQRFCEENSVTLANLTLCAWAIVLRNCTGSDDVCFGYPSAGRDSPVPGIQDAVGIFINMLCCRVKFSPGQTLLEIAKKVQDDFVRNVPHQHCSLAQIQHELGMHGETLFNSTLSIQNRSANKGTRNLPLDFEAQKAHDPTEYPVTVNVETTKGKEGVLLRYWSNAVTEAQAKELAEAVNKVFTCFIEEPSKLVSSLNLLNKLPRNRSQHTHREPLILDQLIDSQVLQKLIDDRVNEIISQMLKEGKLAIPLPDQKTRYSNSSVQLKMVEASLQEDPIIDEKDLANSTPSLTDDGRSSSDNDRRLWDLWKSTLGLSSDTIQYRSSFFKLGGDSITAMKMVSAAREEGLQMTVADVFNNPIFEDMLATITPSSSPTSNADTQCANNIEKLLEVNDALPDATPPQDISVLRPMQLDAMSLLDVICPKIGVFKGGIADVLPVTDFQSMSIAATLFGSRWMLNYFFLDGSGPLDLRRLRESFLRVVDAFDILRTVFVCHHGQFFQVVLRKVRPDIFVHETEQSLDEYTNSLQKRDREQDPRQGEQYVQFYVVKNKNSDQHRILIRMSHAQFDGVCLPKIMNAIKLGYEGSTLPPVFSFSNYMRMLPGNITPAHYHHWSTILKGSKMTDIIRRTQPNTFMHIGAFAEQKKTIMIPSTAIGNVTLATVMQSAWAVTLAKLTAQSDVVFGLTVNGRNASVPGIETTVGPCLNILPIRVKFREHWTGLDLFRYLQDQQIANMPYESLGFREIIRNCTDWPDSTYFTTSVFHQNVEYEGQMHLDGNSYRMGGVGVLDNFTDLTLASKSCGQEKLDVSIGYSLKGPIPATFIAKALNMVCETVQSLIANPSVPLASPATIRSLPSQVIRETPRASDTPFLSSNLNSQKMSEIVIHSDILTRSWQQVLPRRTDNPQYQLDASFFDLGGDIMNVAQLVWILGEEGFSVRLEDLLEHHTFLGMMAVMAMHHKPELNARMAATMAEEPAKDMRMTMTKSNSWSSLGKAMTLAKRFTRWGAVAAKK

SEQ ID NO: 39 - DNA, 35 bp, Artificial Sequence
  PCR Primer
ccggggtaccatggctcaatccaccaagtgctatc

SEQ ID NO: 40 - DNA, 37 bp, Artificial Sequence
  PCR Primer
atatgcggccgccaatgtcgacgaccaagtgatgagc

SEQ ID NO: 41 - DNA, 37 bp, Artificial Sequence
  PCR Primer
atatgcggccgcgcgattccctgagttgcttaaattc

SEQ ID NO: 42 - DNA, 45 bp, Artificial Sequence
  PCR Primer
tatacggccgatatggtacccaagctcgactggtgaccgtgtttc

SEQ ID NO: 43 - DNA, 25 bp, Artificial Sequence
  PCR Primer
cacagagaatgtgccgtttctttgg

SEQ ID NO: 44 - DNA, 24 bp, Artificial Sequence
  PCR Primer
tcacatatcccctactcccgagcc

SEQ ID NO: 45 - DNA, 24 bp, Artificial Sequence
  PCR Primer
atgcctcaatcctgggaagaactg

SEQ ID NO: 46 - DNA, 24 bp, Artificial Sequence
  PCR Primer
cttgacgtagaagacggcaccggc

SEQ ID NO: 47 - DNA, 24 bp, Artificial Sequence
  PCR Primer
ggtttcgaaactgtgcactaaatc

SEQ ID NO: 48 - DNA, 24 bp, Artificial Sequence
  PCR Primer
ttcctcggggacaacgacgtcaac

The invention claimed is:

1. A method for production of a compound of interest by microbial fermentation comprising:
   a. providing a microbial host cell,
   b. culturing said microbial host cell in a culture medium under conditions conducive to expression of the compound of interest, and
   c. isolating the compound of interest from the culture medium,
   wherein said microbial host cell has been modified in the genome thereof resulting in a deficiency in production of at least one non-ribosomal peptide synthase, wherein said microbial host cell is a filamentous fungus, and wherein said at least one non-ribosomal peptide synthase is at least 95% identical to a polypeptide selected from the group consisting of the polypeptide according to SEQ ID NO: 38 (npsE), and the polypeptide according to SEQ ID NO: 34 (Pc16g04690), and/or wherein said microbial host cell has been modified in its genome such that it results in a reduction of the amount of at least one mRNA having at least 90% identity with a mRNA selected from the group consisting of the mRNA according to SEQ ID NO: 37, and the mRNA according to SEQ ID NO: 33.

2. The method according to claim 1, wherein the polypeptide is 100% identical to a polypeptide selected from the group consisting of: the polypeptide according to SEQ ID NO: 38 and the polypeptide according to SEQ ID NO: 34 and/or the mRNA is 100% identical to a mRNA selected from the group consisting of: the mRNA according to SEQ ID NO: 37 and the mRNA according to SEQ ID NO: 33.

3. The method according to claim 1, wherein the deficiency in the production of the at least one non-ribosomal peptide synthase is a reduction in production of at least 40%.

4. The method according to claim 1, wherein the deficiency in the production of the at least one non-ribosomal peptide synthase results in the reduction of production of at least one peptide product, wherein said peptide product comprises at least two coupled amino acids, wherein coupling is mediated by the at least one non-ribosomal peptide synthase; and wherein amino acids of said peptide product may be optionally modified, before and/or after coupling, in chemical structure.

5. The method according to claim 4, wherein the deficiency in the production of the at least one non-ribosomal peptide synthase results in reduction of production of a tetrapeptide.

6. The method according to claim 5, wherein the tetrapeptide is cyclic VVFF (SEQ ID NO: 5).

7. The method according to claim 4, wherein the reduction in the production of the peptide product is at least 20%.

8. The method according to claim 1, wherein the filamentous fungus is an *Aspergillus, Acremonium, Thielavia, Chrysosporium, Myceliophthora, Penicillium, Talaromyces, Fusarium* or *Trichoderma*, preferably a species of *Aspergillus niger, Aspergillus awamori, Aspergillus foetidus, Aspergillus sojae, Aspergillus fumigatus, Talaromyces emersonii, Aspergillus oryzae, Chrysosporium lucknowense, Fusarium oxysporum, Trichoderma reesei, Acremonium alabamense, Myceliophthora thermophila, Thielavia terrestris* or *Penicillium chrysogenum*.

9. The method according to claim 8, wherein the microbial host cell belongs to the genus *Aspergillus* or *Penicillium*.

10. The method according to claim 1, wherein the host cell additionally comprises at least one modification in the genome thereof in a polynucleotide encoding a product selected from the group consisting of glucoamylase (glaA), acid stable alpha-amylase (amyA), neutral alpha-amylase (amyBI and amyBII), oxalic acid hydrolase (oahA), a toxin, preferably ochratoxin and/or fumonisin, and protease transcriptional regulator prtT, such that the host cell is deficient in at least one product encoded by the polynucleotide comprising the modification.

11. The method according to claim 1, wherein the host cell additionally comprises a disruption of pepA gene encoding major extracellular aspartic protease PepA.

12. The method according to claim 1, wherein the host cell additionally comprises a disruption of hdfA gene.

13. The method according to claim 1, wherein the host cell additionally comprises at least two substantially homologous DNA domains suitable for integration of at least one copy of a polynucleotide encoding a compound of interest, wherein at least one of the at least two substantially homologous DNA domains is adapted to have enhanced integration preference for the polynucleotide encoding a compound of interest compared to the substantially homologous DNA domain the domain originates from, and wherein the substantially homologous DNA domain where the adapted substantially homologous DNA domain originates from has a gene conversion frequency that is at least 10% higher than another of the at least two substantially homologous DNA domains.

14. The method according to claim 13, wherein the host cell is an *Aspergillus niger* host cell, comprising at least two amplicons, and wherein the amplicon which has the highest frequency of gene conversion has been adapted to have enhanced integration preference for the polynucleotide encoding a compound of interest compared to the amplicon from which the amplicon having the highest frequency of gene conversion originates from.

15. The method according to claim 1, wherein the host cell additionally comprises a modification of Sec61.

16. The method according to claim 1, wherein the compound of interest is a biological compound selected from the group consisting of biomass, a biopolymer, and a metabolite, preferably a biopolymer selected from a nucleic acid, polyamine, polyol, polypeptide, optionally a protein and/or an enzyme, or polyamide, polysaccharide and a metabolite selected from a primary or secondary metabolite.

17. A microbial host cell that has been modified in the genome thereof resulting in a deficiency in production of at least one non-ribosomal peptide synthase, wherein the microbial host cell is a filamentous fungus, and wherein the at least one nucleic acid sequence encoding at least one non-ribosomal peptide synthase has at least 95% identity with a polypeptide selected from the group consisting of the polypeptide according to SEQ ID NO: 38 (npsE), and the polypeptide according to SEQ ID NO: 34 (Pc16g04690), and/or wherein said microbial host cell has been modified in its genome resulting in a reduction of the amount of at least one mRNA having at least 90% identity with an mRNA selected from the group consisting of the mRNA according to SEQ ID NO: 37, and the mRNA according to SEQ ID NO: 33.

18. The microbial host cell according to claim 17, wherein the polypeptide is 100% identical to a polypeptide selected from the group consisting of the polypeptide according to SEQ ID NO: 38 and the polypeptide according to SEQ ID NO: 34, and the mRNA is 100% identical to a mRNA selected from the group consisting of the mRNA according to SEQ ID NO: 37 and the mRNA according to SEQ ID NO: 33.

19. The microbial host cell according to claim 17, wherein the deficiency in the production of the at least one non-ribosomal peptide synthase by the microbial host cell is a reduction in production of at least 40%.

20. The microbial host cell according to claim 17, wherein the deficiency in the production of the at least one non-ribosomal peptide synthase results in the reduction of the production of at least one peptide product, wherein said peptide product comprises at least two coupled amino acids, wherein coupling is mediated by the at least one non-ribosomal peptide synthase; and wherein the amino acids of said peptide product may optionally be modified, before and/or after coupling, in chemical structure.

21. The microbial host cell according to claim 17, wherein the deficiency in the production of the at least one non-ribosomal peptide synthase results in reduction of production of a tetrapeptide.

22. The microbial host cell according to claim 20, wherein the reduction in the production of the peptide product is at least 20%.

23. The microbial host cell according to claim 17, wherein the filamentous fungus is selected from the group consisting of *Aspergillus, Acremonium, Myceliophthora, Thielavia Chrysosporium, Penicillium, Talaromyces, Fusarium*, and *Trichoderma*.

24. The microbial host cell according to claim 23, wherein the filamentous fungus belongs to the genus *Aspergillus* or *Penicillium*.

25. The microbial host cell according to claim 23, which additionally comprises at least one modification in the genome in a polynucleotide encoding a product selected from the group consisting of glucoamylase (glaA), acid stable alpha-amylase (amyA), neutral alpha-amylase (amyBI and amyBII), oxalic acid hydrolase (oahA), a toxin, and protease transcriptional regulator prtT, such that the host cell is deficient in at least one product encoded by the polynucleotide comprising the modification.

26. The microbial host cell according to claim 23, wherein the host cell additionally comprises a disruption of the pepA gene encoding major extracellular aspartic protease PepA.

27. The microbial host cell according to claim 23, wherein the host cell additionally comprises a disruption of hdfA gene.

28. The microbial host cell according to claim 23, wherein the host cell additionally comprises at least two substantially homologous DNA domains suitable for integration of at least one copy of a polynucleotide encoding a compound of interest, wherein at least one of the at least two substantially homologous DNA domains is adapted to have enhanced integration preference for the polynucleotide encoding a compound of interest compared to the substantially homologous DNA domain the domain originates from, and wherein the substantially homologous DNA domain where the adapted substantially homologous DNA domain originates from has a gene conversion frequency that is at least 10% higher than another of the at least two substantially homologous DNA domains.

29. The microbial host cell according to claim 28, wherein the host cell is an *Aspergillus niger* host cell, comprising at least two amplicons, and wherein the amplicon which has the highest frequency of gene conversion has been adapted to have enhanced integration preference for the polynucleotide encoding a compound of interest compared to the amplicon from which the amplicon having the highest frequency of gene conversion originates from.

30. The microbial host cell according to claim 23, wherein the host cell additionally comprises a modification of Sec61.

31. The microbial host cell according to claim 21, wherein the tetrapeptide is cyclic VVFF (SEQ ID NO: 5).

32. The microbial cell according to claim 23, wherein the filamentous fungus is selected from the group consisting of *Aspergillus niger, Aspergillus awamori, Aspergillus foetidus, Aspergillus sojae, Aspergillus fumigatus, Talaromyces emersonii, Aspergillus oryzae, Acremonium alabamense, Myceliophthora thermophila, Thielavia terrestris Chrysosporium lucknowense, Fusarium oxysporum, Trichoderma reesei*, and *Penicillium chrysogenum*.

33. The microbial cell according to claim 24, wherein the microbial host cell is an *Aspergillus niger* or *Penicillium chrysogenum*.

34. The microbial cell according to claim 25, wherein the toxin is ochratoxin and/or fumonisin.

35. The microbial cell according to claim 29, wherein the at least two amplicons are at least two ΔglaA amplicons.

36. The microbial cell according to claim 30, wherein the SEC61 modification is the S376W mutation in which serine 376 is replaced by tryptophan.

37. The method according to claim 9, wherein the microbial host cell is an *Aspergillus niger* or *Penicillium chrysogenum*.

38. The method according to claim 14, wherein the at least two amplicons are at least two ΔAglaA amplicons.

39. The method according to claim 15, wherein the SEC61 modification is the S376W mutation in which serine 376 is replaced by tryptophan.

* * * * *